United States Patent 11,446,398 (REGULATED BIOCIRCUIT SYSTEMS) - sequence listing, part 28

SEQ ID NO: 110088 - DNA, 4778 bp, Homo sapiens
  Payload ID: 1610
  Gene Symbol: ABCB1
  Gene Name: ATP-binding cassette, sub-family B (MDR/TAP), member 1
  Uniprot ID: P08183
  ENST ID: ENST00000622132
  CDS Start-End: 326-4168
tgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaaaatttcacgtcttggtggccgttccaaggagcgcgaggtcggaatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggttctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagattgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccaca

SEQ ID NO: 110089 - DNA, 3857 bp, Homo sapiens
  Payload ID: 1611
  Gene Symbol: ABCB10
  Gene Name: ATP-binding cassette, sub-family B (MDR/TAP), member 10
  Uniprot ID: Q9NRK6
  ENST ID: ENST00000344517
  CDS Start-End: 44-2260
cgcctggccggcgggctgaggcgtacgggtcgcacgcagcgccatgcgaggcccccctgcctggccgctgcggctgctcgagccaccgagccctgccgagccaggtcggctcctgccggtagcctgcgtgtgggccgcggccagccgcgttcccgggtccctatcgccgttcactggcctgaggccggcgcggctatggggcgcggggcccgcgctgctctggggcgttggagccgcgcgccgctggaggagcggctgccggggcgggggtccgggcgcctcgcggggcgtcctgggcctcgcgcggctcctggggctgtgggctcgcggccccggcagctgcaggtgcggggcttttgccgggccaggcgctcctcggctcccgcgcgcccggttcccgggcggtcccgcagccgctgcctgggcaggggacgaggcctggcggcgcgggccggcggcgcctcccggggacaaggggcggctgcgccccgcagcggccggactcccggaggcccggaagctcctggggctggcgtaccctgagcgccggaggctggcagctgcggttggatttctcacgatgtccagtgttatctccatgtctgcccctttcttcctggggaagatcattgatgtcatctataccaaccccactgtggactacagcgacaacctgacccgcctctgcctagggctcagtgccgtgtttctgtgtggtgctgccgccaatgccattcgtgtctacctcatgcaaacttcaggtcagcgcattgtgaataggctgagaacttcattattctcctccattctgaggcaggaggttgctttctttgacaagactcgcacaggagaattgattaaccgcctctcatcagacactgcactcctggggcgctcagtgactgaaaacctctcagatgggctcagggccggggcccaggcttccgtaggcatcagtatgatgttttttgtctcacctaatctggccacctttgttttgagcgtggtgcctccagtgtcaatcattgctgtaatttatgggcgatatctacggaaactgaccaaagtcactcaggattccctggcacaagccactcagctagctgaggaacgtattggaaatgtaagaactgttcgagcttttgggaaagaaatgactgaaatcgagaaatatgccagcaaagtggaccatgtaatgcagttagcaaggaaagaggcattcgcccgggctggtttctttggagcaactgggctctccggaaacctgatcgtgctttctgtcctgtacaaaggagggctgctgatgggcagtgcccacatgaccgtgggtgaactctcttccttcctaatgtatgctttctgggttggaataagcattggaggtctgagctctttctactcggagctgatgaaaggactgggtgcaggggggcgcctctgggagctcctggagagagagcccaagctgccttttaacgagggggtcatcttaaatgagaaaagcttccagggtgctttggagtttaagaacgtgcattttgcctatccagctcgcccagaggtgcccatatttcaggatttcagcctttccattccgtcaggatctgtcacggcactggttggcccaagtggttctggcaaatcaacagtgctttcactcctgctgaggttgtacgaccctgcttctggaactattagtcttgatggccatgacatccgtcagctaaacccagtgtggctgagatccaaaattgggacagtgagtcaggaacccattttgttttcttgctctattgctgagaacattgcttatggtgctgatgacccttcctctgtgaccgctgaggaaatccagagagtggctgaagtggccaatgcagtggccttcatccggaatttcccccaagggttcaacactgtggttggagaaaagggtgttctcctctcaggtgggcagaaacagcggattgcgattgcccgtgctctgctaaagaatcccaaaattcttctcctagatgaagcaaccagtgcgctggatgccgaaaatgagtaccttgttcaagaagctctagatcgactgatggatggaagaacggtgttagttattgcccatcgtctgtccaccattaagaatgctaatatggttgctgttcttgaccaaggaaaaattactgaatatggaaaacatgaagagctgctttcaaaaccaaatgggatatacagaaaactaatgaacaaacaaagttttatttcagcataaggaagcaattactggtaaacaatatgagactttaatgcaaaacagtgttgcagaaaaaaaactcagagactatgaaatacataaaccatatatcaagttatttgaaaaatacctatttttttccaaagtgtgtaaaagattgttttgaaacgtacctgttctcaagatctttttattcagagttttaataattgtaactttttaaatgtctatagcactgaagttattttcaggttttgtattttcttttcttgtggaatattttaattaatatagcatggcacctcattttcttttgcctgctgttaaagattgaagctattgtcaaatgacaactttaaaaaggcaattataaataaaaagcctgattattttaggccagtttaccaatcactgtgtaattcttctggtagtattctacctacttttaagtctaattttacagatagaataatggaaattgaaaatttaaccctttattccgataatctcatgaagcaaacctaactatttaacatcagctggaaagaagggaacatttatattgcccatctcctgtgtcttcaaaggtgtgagagctgaggaatatgtgttcctatgggaactatgtttgaatatgtgcagttttcaacattttggcacatgaaagcctgacaagtttttaaaagggcagaagctttattttttgaacaggaaaacatgttttttaaattcacatgtttgtatgagtacttttgcgaagcaaggcatgaactgctaggtattattaagaatgaatgatttttgcatttaagttgtttgaaggcatgtattttgaaaaatatctgttacaaatttataatttcaagacaaattgaatcttattttataatacttttggaatttcattaataaggctaaaatttgaggaatataactaattttcagccttaagacatttaagtttggaagtccttgctattcaacagaataacaagaaaacttcagaatgtatcactctcctgaaaagaagatattaataagcccttttatttatggttatagttttatttatagtctcaaaattcctaaagcaatgctacaaccattgaatttgccatattttgtatcagtgctgttaatttgctgttgcctcaagaaaaagtgctttttctccatggatgaggctagaccctaagaagtaattaagtcaatgtaaatcaaatggaagttttcccatgaactaagcatttattagttccctgattagactggaagaagaaaccactatttcatgaaaagcatggaatattatattttattgttcataattaatgaataaaattgatatgaatgaatatagtgttctttgaattagtaaacagtacatctgtgacaatcatttttaacaagctctacttgtgttctttataaagtgtgattttcagaaagcaaacaacacaattacaaggttgaatctgaggaaaataatccttgtgccatagaagtatttacgaaattgcatttcattgttatgttttattttctgatacatgatgttcaattttatctttaggtaatattttatatcatagattaaaatttatagtgaacttta

SEQ ID NO: 110090 - DNA, 4775 bp, Homo sapiens
  Payload ID: 1612
  Gene Symbol: ABCB11
  Gene Name: ATP-binding cassette, sub-family B (MDR/TAP), member 11
  Uniprot ID: O95342
  ENST ID: ENST00000263817
  CDS Start-End: 126-4091
aatgatgaaaaccgaggttggaaaaggttgtgaaaccttttaactctccacagtggagtccattatttcctctggcttcctcaaattcatattcacagggtcgttggctgtgggttgcaattaccatgtctgactcagtaattcttcgaagtataaagaaatttggagaggagaatgatggttttgagtcagataaatcatataataatgataagaaatcaaggttacaagatgagaagaaaggtgatggcgttagagttggcttctttcaattgtttcggttttcttcatcaactgacatttggctgatgtttgtgggaagtttgtgtgcatttctccatggaatagcccagccaggcgtgctactcatttttggcacaatgacagatgtttttattgactacgacgttgagttacaagaactccagattccaggaaaagcatgtgtgaataacaccattgtatggactaacagttccctcaaccagaacatgacaaatggaacacgttgtgggttgctgaacatcgagagcgaaatgatcaaatttgccagttactatgctggaattgctgtcgcagtacttatcacaggatatattcaaatatgcttttgggtcattgccgcagctcgtcagatacagaaaatgagaaaattttactttaggagaataatgagaatggaaatagggtggtttgactgcaattcagtgggggagctgaatacaagattctctgatgatattaataaaatcaatgatgccatagctgaccaaatggcccttttcattcagcgcatgacctcgaccatctgtggtttcctgttgggatttttcaggggttggaaactgaccttggttattatttctgtcagccctctcattgggattggagcagccaccattggtctgagtgtgtccaagtttacggactatgagctgaaggcctatgccaaagcaggggtggtggctgatgaagtcatttcatcaatgagaacagtggctgcttttggtggtgagaaaagagaggttgaaaggtatgagaaaaatcttgtgttcgcccagcgttggggaattagaaaaggaatagtgatgggattctttactggattcgtgtggtgtctcatctttttgtgttatgcactggccttctggtacggctccacacttgtcctggatgaaggagaatatacaccaggaacccttgtccagattttcctcagtgtcatagtaggagctttaaatcttggcaatgcctctccttgtttggaagcctttgcaactggacgtgcagcagccaccagcatttttgagacaatagacaggaaacccatcattgactgcatgtcagaagatggttacaagttggatcgaatcaagggtgaaattgaattccataatgtgaccttccattatccttccagaccagaggtgaagattctaaatgacctcaacatggtcattaaaccaggggaaatgacagctctggtaggacccagtggagctggaaaaagtacagcactgcaactcattcagcgattctatgacccctgtgaaggaatggtgaccgtggatggccatgacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacagcaatttgacacccttgttggagaaggaggaggccagatgagtggtggccagaaacaaagggtagctatcgccagagccctcatccgaaatcccaagattctgcttttggacatggccacctcagctctggacaatgagagtgaagccatggtgcaagaagtgctgagtaagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaaggatgcaactgaagatgacatgcttgcgaggacctttagcagagggagctaccaggatagtttaagggcttccatccggcaacgctccaagtctcagctttcttacctggtgcacgaacctccattagctgttgtagatcataagtctacctatgaagaagatagaaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttgggactttttcaattcctgataaagaggaacaaaggtcacagatcaatggtgtgtgcctactttttgtagcaatgggctgtgtatctcttttcacccaatttctacagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcaacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtgatgatagatggtcatgacagcaaaaaagtaaatgtccagttcctccgctcaaacattggaattgtttcccaggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttacttttacagtcattttcctacatcggaatccaagctaatttctaatggccttccataataattctgctttagatgtgtatacagaaaatgaaagaaactagggtccatatgagggaaaacccaatgtcaagtggcagctcagccaccactcagtgcttctctgtgcaggagccagtcctgattaatatgtgggaattagtgagacatcagggagtaagtgacactttgaactcctcaagggcagagaactgtctttcatttttgaaccctcggtgtacacagaggcgggtctataacaggcaatcaacaaacgtttcttgagctagaccaaggtcagatttgaaaagaacagaaggactgaagaccagctgtgtttcttaactaaatttgtctttcaagtgaaaccagcttccttcatctctaaggctaaggatagggaaagggtggatgctctcaggctgagggaggcagaaagggaaagtattagcatgagctttccagttagggctgttgatttatgctttaacttcagagtgagtgtaggggtggtgatgcta

SEQ ID NO: 110091 - DNA, 2822 bp, Homo sapiens
  Payload ID: 1612
  Gene Symbol: ABCB11
  Gene Name: ATP-binding cassette, sub-family B (MDR/TAP), member 11
  ENST ID: ENST00000439188
  CDS Start-End: 1-219
gacattcgctctcttaacattcagtggcttagagatcagattgggatagtggagcaagagccagttctgttctctaccaccattgcagaaaatattcgctatggcagagaagatgcaacaatggaagacatagtccaagctgccaaggaggccaatgcctacaacttcatcatggacctgccacagggatatttctttcagtggaagtcggagcagtgaaaattcgtgcttgagaagaaaactatgacagaaaggacattatagtggatcactgtcagaagccatcaaattcttttcccttcatgactggtgtcaccttccatctagcaatttgacacccttgttggagaaggaggaggccagatgagtggtggccagaaacaaagggtagctatcgccagagccctcatccgaaatcccaagattctgcttttggacatggccacctcagctctggacaatgagagtgaagccatggtgcaagaagtgctgagtaagattcagcatgggcacacaatcatttcagttgctcatcgcttgtctacggtcagagctgcagataccatcattggttttgaacatggcactgcagtggaaagagggacccatgaagaattactggaaaggaaaggtgtttacttcactctagtgactttgcaaagccagggaaatcaagctcttaatgaagaggacataaaggatgcaactgaagatgacatgcttgcgaggacctttagcagagggagctaccaggatagtttaagggcttccatccggcaacgctccaagtctcagctttcttacctggtgcacgaacctccattagctgttgtagatcataagtctacctatgaagaagatagaaaggacaaggacattcctgtgcaggaagaagttgaacctgccccagttaggaggattctgaaattcagtgctccagaatggccctacatgctggtagggtctgtgggtgcagctgtgaacgggacagtcacacccttgtatgcctttttattcagccagattcttgggactttttcaattcctgataaagaggaacaaaggtcacagatcaatggtgtgtgcctactttttgtagcaatgggctgtgtatctcttttcacccaatttctacagggatatgcctttgctaaatctggggagctcctaacaaaaaggctacgtaaatttggtttcagggcaatgctggggcaagatattgcctggtttgatgacctcagaaatagccctggagcattgacaacaagacttgctacagatgcttcccaagttcaaggggctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcaacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttacttttacagtcattttcctacatcggaatccaagctaatttctaatggccttccataataattctgctttagatgtgtatacagaaaatgaaagaaactagggtccatatga

SEQ ID NO: 110092 - DNA, 2040 bp, Homo sapiens
  Payload ID: 1612
  Gene Symbol: ABCB11
  Gene Name: ATP-binding cassette, sub-family B (MDR/TAP), member 11
  ENST ID: ENST00000618180
  CDS Start-End: 1-1356
gctgccggctctcagatcgggatgatagtcaattccttcactaacgtcactgtggccatgatcattgccttctcctttagctggaagctgagcctggtcatcttgtgcttcttccccttcttggctttatcaggagccacacagaccaggatgttgacaggatttgcctctcgagataagcaggccctggagatggtgggacagattacaaatgaagccctcagtaacatccgcactgttgctggaattggaaaggagaggcggttcattgaagcacttgagactgagctggagaagcccttcaagacagccattcagaaagccaatatttacggattctgctttgcctttgcccagtgcatcatgtttattgcgaattctgcttcctacagatatggaggttacttaatctccaatgaggggctccatttcagctatgtgttcagggtgatctctgcagttgtactgagtgcaacagctcttggaagagccttctcttacaccccaagttatgcaaaagctaaaatatcagctgcacgcttttttcaactgctggaccgacaacccccaatcagtgtatacaatactgcaggtgaaaaatgggacaacttccaggggaagattgattttgttgattgtaaatttacatatccttctcgacctgactcgcaagttctgaatggtctctcagtgtcgattagtccagggcagacactggcgtttgttgggagcagtggatgtggcaaaagcactagcattcagctgttggaacgtttctatgatcctgatcaagggaaggtgatgatagatggtcatgacagcaaaaaagtaaatgtccagttcctccgctcaaacattggaattgtttcccaggaaccagtgttgtttgcctgtagcataatggacaatatcaagtatggagacaacaccaaagaaattcccatggaaagagtcatagcagctgcaaaacaggctcagctgcatgattttgtcatgtcactcccagagaaatatgaaactaacgttgggtcccaggggtctcaactctctagaggggagaaacaacgcattgctattgctcgggccattgtacgagatcctaaaatcttgctactagatgaagccacttctgccttagacacagaaagtgaaaagacggtgcaggttgctctagacaaagccagagagggtcggacctgcattgtcattgcccatcgcttgtccaccatccagaacgcggatatcattgctgtcatggcacagggggtggtgattgaaaaggggacccatgaagaactgatggcccaaaaaggagcctactacaaactagtcaccactggatcccccatcagttgacccaatgcaagaatctcagacacacatgacgcaccagttacaggggttgtttttaaagaaaaaaacaatcccagcaggagggattgctgggattgttttttctttaaagaagaatgttaatattttacttttacagtcattttcctacatcggaatccaagctaatttctaatggccttccataataattctgctttagatgtgtatacagaaaatgaaagaaactagggtccatatgagggaaaacccaatgtcaagtggcagctcagccaccactcagtgcttctctgtgcaggagccagtcctgattaatatgtgggaattagtgagacatcagggagtaagtgacactttgaactcctcaagggcagagaactgtctttcatttttgaaccctcggtgtacacagaggcgggtctataacaggcaatcaacaaacgtttcttgagctagaccaaggtcagatttgaaaagaacagaaggactgaagaccagctgtgtttcttaactaaatttgtctttcaagtgaaaccagcttccttcatctctaaggctaaggatagggaaagggtggatgctctcaggctgagggaggcagaaagggaaagtattagcatgagctttccagttagggctgttgatttatgctttaacttcagagtgagtgtaggggtggtgatgcta

SEQ ID NO: 110093 - DNA, 4020 bp, Homo sapiens
  Payload ID: 1613
  Gene Symbol: ABCB4
  Gene Name: ATP-binding cassette, sub-family B (MDR/TAP), member 4
  Uniprot ID: P21439
  ENST ID: ENST00000265723
  CDS Start-End: 113-3973
gggcgggggcgggggcgggggcgaggccgcggcgagcaaagtccaggcccctctgctgcagcgcccgcgcgtccagaggccctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaacgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacca

SEQ ID NO: 110094 - DNA, 3826 bp, Homo sapiens
  Payload ID: 1613
  Gene Symbol: ABCB4
  Gene Name: ATP-binding cassette, sub-family B (MDR/TAP), member 4
  Uniprot ID: P21439
  ENST ID: ENST00000358400
  CDS Start-End: 77-3775
caaagtccaggcccctctgctgcagcgcccgcgcgtccagaggccctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaacgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacagggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctaccatttt

SEQ ID NO: 110095 - DNA, 3923 bp, Homo sapiens
  Payload ID: 1613
  Gene Symbol: ABCB4
  Gene Name: ATP-binding cassette, sub-family B (MDR/TAP), member 4
  Uniprot ID: P21439
  ENST ID: ENST00000359206
  CDS Start-End: 33-3872
cctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaacgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctaccatttt

SEQ ID NO: 110096 - DNA, 3699 bp, Homo sapiens
  Payload ID: 1613
  Gene Symbol: ABCB4
  Gene Name: ATP-binding cassette, sub-family B (MDR/TAP), member 4
  Uniprot ID: P21439
  ENST ID: ENST00000453593
  CDS Start-End: 1-3699
atggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaacgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacagggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatga

SEQ ID NO: 110097 - DNA, 2007 bp, Homo sapiens
  Payload ID: 1613
  Gene Symbol: ABCB4
  Gene Name: ATP-binding cassette, sub-family B (MDR/TAP), member 4
  ENST ID: ENST00000417608
  CDS Start-End: 1825-2007
tagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaagaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtacc

SEQ ID NO: 110098 - DNA, 523 bp, Homo sapiens
  Payload ID: 1613
  Gene Symbol: ABCB4
  Gene Name: ATP-binding cassette, sub-family B (MDR/TAP), member 4
  ENST ID: ENST00000440025
  CDS Start-End: 1-298
catcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatgatcaatttagaagacccaatttggggtttattacggcatttgaaatttgagagttagaagtgacacctgtcttgatgaagtattgaaacaacaggctagctctccctaagttattagaaacatccagaaaaagaacaaaattcaaggtaagtacaggtgtagaaatatagaagccacagacatagggaaatggtcttatggtcctgaatgggttgggtagacaggaaagtttgggaataattttcccaagtacaaaagaaaaataaattgttcaatagcctc

SEQ ID NO: 110099 - DNA, 2906 bp, Homo sapiens
  Payload ID: 1614
  Gene Symbol: ABCB5
  Gene Name: ATP-binding cassette, sub-family B (MDR/TAP), member 5
  Uniprot ID: Q2M3G0
  ENST ID: ENST00000258738
  CDS Start-End: 468-2906
cctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtga

SEQ ID NO: 110100 - DNA, 1483 bp, Homo sapiens
  Payload ID: 1614
  Gene Symbol: ABCB5
  Gene Name: ATP-binding cassette, sub-family B (MDR/TAP), member 5
  Uniprot ID: Q2M3G0
  ENST ID: ENST00000406935
  CDS Start-End: 547-927
attgcttctcggccttttggctaagatcaagtgtaatctgtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaagaaaaaataatacaacaaagacgtattgataatctaccacactatctacgttgaggtatctggaaccacagtggtatgaattgcactatctccctaatctttacactaattctggctaaaagacagcatcagctcaaattttcctgatcagttttttagcaggctttggctgccaaaatctcttctgtgttttaagtctgaagcaattacagttgaatattttgttgttgttcactatgaggagtatatcggttttaggtcacatgaatgatctagtagagatgtatttttctagtacacttgatagtaccttgaatatgtacagtacatgtaggcccattttatggacctctgaggcacagttttttcccttttaagttattagatatttctgtgatttatttgatgcactcagatacaaattcatgctataataagttaaattgtaacataatatctaccttaatcaaatatttatagtttaggccaggagcctggcaaagtaaagatgacacagatgaaatgcttgataagtaaataaatatgagaagagatatatattaaaa

SEQ ID NO: 110101 - DNA, 5811 bp, Homo sapiens
  Payload ID: 1614
  Gene Symbol: ABCB5
  Gene Name: ATP-binding cassette, sub-family B (MDR/TAP), member 5
  Uniprot ID: Q2M3G0
  ENST ID: ENST00000404938
  CDS Start-End: 653-4426
aaattataaaagttgtcctaaaaattggttcagtgccttttacaatcgtatgtaccttatctctctctccatttctgcatgaacagtccatcctatccaaaccgttctcatttctctaccatgagataattcaccttgcattcctaaaactatgcccttgttcctcctccacatttttctacttactgaaaccttagccttcctccagaaactaacctcagggccatcctcatctgtgggcgaaaccattttagatcacaatgttcttcctcagtcttcttagatactagaatagtcactctttgtactattcatcacataacgtctgtcttgccaggtatattaggttcccctagagaaatagaatcaataggccgtgtgtgtgtgtgtgtgtgtgtgtgtgtgtgtgtgtgtatgtagagagagaaagagaaaacacgctcatgtaattgtggtgactggcacttccaaaatccacaagccagactagaaggctggaaattctggcaaaaaattgataccttgtatctgaaagctttatcctatcctcttcagaagacttcagtcttttctcttaaggacttcaactgactggatggggcccactcaaaacagcatctaaggaattaaaaagaagtaaattgtaaataagatggaaaattcagaaagagctgaagaaatgcaagaaaattatcagagaaatggaactgcagaagaacagccaaaactgagaaaggaagcagttggatctattgagatattccgctttgctgatggactggacatcacactcatgatcctgggtatactggcatcactggtcaatggagcctgccttcctttaatgccactggttttaggagaaatgagtgataaccttattagtggatgtctagtccaaactaacacaacaaattatcagaactgtactcagtctcaagagaagctgaatgaagatatgactctgttgaccctgtattatgttggaataggtgttgctgccttgatttttggttacatacagatttccttgtggattataactgcagcacgacagaccaagaggattcgaaaacagttttttcattcagttttggcacaggacatcggctggtttgatagctgtgacatcggtgaacttaacactcgcatgacagatgacattgacaaaatcagtgatggtattggagataagattgctctgttgtttcaaaacatgtctactttttcgattggcctggcagttggtttggtgaagggctggaaactcaccctagtgactctatccacgtctcctcttataatggcttcagcggcagcatgttctaggatggtcatctcattgaccagtaaggaattaagtgcctattccaaagctggggctgtggcagaagaagtcttgtcatcaatccgaacagtcatagcctttagggcccaggagaaagaacttcaaaggtatacacagaatctcaaagatgcaaaggattttggcataaaaaggactatagcttcaaaagtgtctcttggtgctgtgtacttctttatgaatggaacctatggacttgctttttggtatggaacctccttgattcttaatggagaacctggatataccatcgggactgttcttgctgttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggcgagcaaaggtcggactacaatcgtggtagcacaccgactttctactattcgaagtgcagatttgattgtgaccctaaaggatggaatgctggcggagaaaggagcacatgctgaactaatggcaaaacgaggtctatattattcacttgtgatgtcacaggatattaaaaaagctgatgaacagatggagtcaatgacatattctactgaaagaaagaccaactcacttcctctgcactctgtgaagagcatcaagtcagacttcattgacaaggctgaggaatccacccaatctaaagagataagtcttcctgaagtctctctattaaaaattttaaagttaaacaagcctgaatggccttttgtggttctggggacattggcttctgttctaaatggaactgttcatccagtattttccatcatctttgcaaaaattataaccatgtttggaaataatgataaaaccacattaaagcatgatgcagaaatttattccatgatattcgtcattttgggtgttatttgctttgtcagttatttcatgcagggattattttacggcagagcaggggaaattttaacgatgagattaagacacttggccttcaaagccatgttatatcaggatattgcctggtttgatgaaaaggaaaacagcacaggaggcttgacaacaatattagccatagatatagcacaaattcaaggagcaacaggttccaggattggcgtcttaacacaaaatgcaactaacatgggactttcagttatcatttcctttatatatggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagaaatacaacacacaagttggactgaaaggagcacagctttctggcggccagaaacaaagactagctattgcaagggctcttctccaaaaacccaaaattttattgttggatgaggccacttcagccctcgataatgacagtgagaaggtggttcagcatgcccttgataaagccaggacgggaaggacatgcctagtggtcactcacaggctctctgcaattcagaacgcagatttgatagtggttctgcacaatggaaagataaaggaacaaggaactcatcaagagctcctgagaaatcgagacatatattttaagttagtgaatgcacagtcagtgcagtgatgctgttgaggtagcacatattttgatgttcgtgtaatgcaaagaaggagtacttaataattacttggcaagctttgatctcttttattgcatatatcaatacctagaatcatgctactcaagtacatacatgttctattcacacaccatctgaccttcagatttttaaaaggaagcaaaaatttgcttatttcatgtaagtgaaataatgcttatatccttcactttataaaactattctagcacatttgcttgtaaagcagttttctacaaggtgaatttatttcccatcaacttctgctataaaatcggaaatatgtttccagggggaatattatccaattaaccatgttgaaggttttagcaaaggcagtgtaagatagagtggggcctgtagcattgcagggagagtgtctttcacttggaattttgttttgcagcacatattacagtagttttgctagtcccttttctccagaccgtagggatttctctcaataagtattcactatttctctaaattttattctatttttttgttgagcagggaatagaaaggattacgatgtaaaatttctgggaggattaggtagctatctcctacttcaccagtaagtgaagtgcctcacatgagccatcccaaagattcattattccaaaccttgggtttggcagtataagtcacaggcctacctgtttatgaaaacttacttacttaaaataagagctacttttgggccgggtgcggtggctcacgcctgtaatcccagaactttgggaggccgaggagggcggatcacttgaggtcaggagttcgagaccagcctggccaacatggtgaaaccccgtctctactaaaaacacaaaaattagccaatcttggtggcgggcacctggaatcccagctacttgggaggctgaggcaggagaatcatttgaacctaggaggcagaggttgcagtgagccgagatctcaccactgcactccagcctgcgcaacagagcgagactccatctcaaaaaataataaataagagctaattttattgtgggtgaaaatttttaaacgtctttctctataataaaataatttccttaaattttatatatactttatcatatataatgtgtgaatgattttaaagttctgtgtaaataacaatattggtaaaatgagttacattttcaacttacttaaatatgtaatgtcacctggtgattttatctttattcttcagtgtattttcttccatttacacatttagctagcctccctaaagtgtactctaccaataattgaaatcttgttaaacaaaattaaaaccatttatatattatgctgctttctttaaaatgcaaaataaaaataagattggggacttgag

SEQ ID NO: 110102 - DNA, 2204 bp, Homo sapiens
  Payload ID: 1614
  Gene Symbol: ABCB5
  Gene Name: ATP-binding cassette, sub-family B (MDR/TAP), member 5
  ENST ID: ENST00000441315
  CDS Start-End: 1-945
ggatgggagatgacattcctgattctgagtattgctccagtacttgccgtgacaggaatgattgaaaccgcagcaatgactggatttgccaacaaagataagcaagaacttaagcatgctggaaagatagcaactgaagctttggagaatatacgtactatagtgtcattaacaagggaaaaagccttcgagcaaatgtatgaagagatgcttcagactcaacacagaaatacctcgaagaaagcacagattattggaagctgttatgcattcagccatgcctttatatattttgcctatgcggcagggtttcgatttggagcctatttaattcaagctggacgaatgaccccagagggcatgttcatagtttttactgcaattgcatatggagctatggccatcggagaaacgctcgttttggctcctgaatattccaaagccaaatcgggggctgcgcatctgtttgccttgttggaaaagaaaccaaatatagacagccgcagtcaagaagggaaaaagccagacacatgtgaagggaatttagagtttcgagaagtctctttcttctatccatgtcgcccagatgttttcatcctccgtggcttatccctcagtattgagcgaggaaagacagtagcatttgtggggagcagcggctgtgggaaaagcacttctgttcaacttctgcagagactttatgaccccgtgcaaggacaagtgctgtttgatggtgtggatgcaaaagaattgaatgtacagtggctccgttcccaaatagcaatcgttcctcaagagcctgtgctcttcaactgcagcattgctgagaacatcgcctatggtgacaacagccgtgtggtgccattagatgagatcaaagaagccgcaaatgcagcaaatatccattcttttattgaaggtctccctgagagcctagagtgttgattgtagcaccaaggtcttctgtccacaatttattcagcaagatagctgatgcagtcatggctcacagagtgcactggatcaatgtgaggaccaaaccaaaattttggcagcagctgcatggtctcattaaattaaccaggcacacccagaaaatattctgtatccacatccctaaaacaagattgaactcagctcaagcaacttcgggtccggactctcctcaggaatcaaaccaaaaagcactatttcactaaaagaagtgaagatagttggccagactaaatccaggtatttggacataaatctcaggtggctcatctgccttttcccaggaaaatgcggccccagctttcatcagtgtgtgctttgtcttgatagaaatgcataatcatcaaagctaagtattttttttacctcaaatataagatcctttagcactgattttaaaagtattcgtaaaccacttataaactacgaatgaaaaaataaaggacgacacagatttgtaggggcaagaaaggtgagtagggaaggactagatcatctgcatcgagatttgaaagacacttgtggcttacttgcaaagcttcttttagcattgagcgtacgagggaaattctgttcttgatgacagcgcagtgggaattcccactccaacaacccatgaaatgttactgcataattattcaccttctgaggcccattacgacttatcagcagagaaagaaatttaatttaaactcacccctctgtgctaaagaatgactgggacatgagatcaaagcgcgaagctctgtcctccagtggtttgcaacacctaggcacaatagggtgagagaacgcggcattccagcgcttcccagctttccggaccccggagagagggggtgggggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttccttccccactgtgggggattggggtcagtggagcccgtggatttagccacgaggggacatgactggagccctgtcacgcgcaggtgtgcgtctccgagagctctttcaatataagtgcgggagaagatttatgctgcagcctcatcacaggatgccttaaatgcatgtacatagtgcgtatctaaccacccataaaagccaagtttaatccttg

SEQ ID NO: 110103 - DNA, 2247 bp, Homo sapiens
  Payload ID: 1614
  Gene Symbol: ABCB5
  Gene Name: ATP-binding cassette, sub-family B (MDR/TAP), member 5
  Uniprot ID: Q2M3G0
  ENST ID: ENST00000443026
  CDS Start-End: 547-942
attgcttctcggccttttggctaagatcaagtgtaatctgtgttcttttttatttggtcatatcttccattctttcttacctaattcctctaatatctctctgtgagcctaaaccaataattatatattacattctattgtctttcttatataactgcagaaagataaatatcactttgtttgttcctgtaggttttctttagtgtaatccatagcagttattgcattggagcagcagtccctcactttgaaaccttcgcaatagcccgaggagctgcctttcatattttccaggttattgataagaaacccagtatagataacttttccacagctggatataaacctgaatccatagaaggaactgtggaatttaaaaatgtttctttcaattatccatcaagaccatctatcaagattctgaaaggtctgaatctcagaattaagtctggagagacagtcgccttggtcggtctcaatggcagtgggaagagtacggtagtccagcttctgcagaggttatatgatccggatgatggctttatcatggtggatgagaatgacatcagagctttaaatgtgcggcattatcgagaccatattggagtggttagtcaagagcctgttttgttcgggaccaccatcagtaacaatatcaagtatggacgagatgatgtgactgatgaagagatggagagagcagcaagggaagcaaatgcgtatgattttatcatggagtttcctaataaatttaatacattggtaggggaaaaaggagctcaaatgagtggagggcagaaacagaggatcgcaattgctcgtgccttagttcgaaaccccaagattctgattttagatgaggctacgtctgccctggattcagaaagcaagtcagctgttcaagctgcactggagaaggatacccccaggtattcattttgacctaatttcacctcaagtggagaatcgctgaccttgaaccagcgcccttcgacagctctggcccctcaaacctcaccctgacctcctgctgcctatgagctactgcacatacctcaaggccatatgcagttgtggccctgcaccaaattacactgaatctaggaggggagttggcagtggcggtatgaaaaaccattgaacagttttctcgatggcctgactcccttataaaccagagccttcagaccccttacaaggcttaatggcacattttactttgcatttgcttggaagtgagttaagcgtttttttttctctaagaaaatcgcaggcttctttttttaaaatgctgactttatggaaccagaaacggatactggcaggctaaatgtccactgcttcttgaaaaatctcttagttactattatttagtagcaaatcagattgtgcaagtttgaacgcttgtttccctcccataataacaatgccacatgttgcttgtgtgataaataatctttgtttactgtggacacttcggcaatttggttcatcttggtacagaaaatacaaagacaggactaatattttattcattttttatacttagtaactaggacagggatctgtatttagactatattcaagcctcgctctgtcacccatgcttgagtgcaacctctgcccactgtgttcaagcgattctcctgcctcagcctcctgagtagctgggagtacaggcgtgcatcaccacacccagctaatttttgtatttttagtagagacaaggttttgccatgttgaccaggctggtctcaaactcctgacctcaggtgatccgcccacctcggcctcccaaagtgctgggattacaggtgtgcgtctccgcgcccggccagttacataagattttaaaaaatgtattgtaataggctctctgattgtttagaaggtttcatgttgtgcccgcagtattttcatccactggtaatcactttaggtaatcaaaactagttcagacttttaaaataaatagttgcttggtgacatgataaactaataaatgttattcttattggttaatatgaaacatctatcaaaagtgaaaaaagaagaatgcagaatgtttgtaaactgattccaaaattacacaaaatagcaactgtgaaaaaaatgaaggcaatatatgaaaataataacagctatgtggcataattatgggggaatttaacttatttcaaaaattcatttactgtccctgtttttcagttgtttaaaggagaaagagattaaatcaatgtagaaata

SEQ ID NO: 110104 - DNA, 3016 bp, Homo sapiens
  Payload ID: 1615
  Gene Symbol: ABCB6
  Gene Name: ATP-binding cassette, sub-family B (MDR/TAP), member 6 (Langereis blood group)
  Uniprot ID: Q9NP58
  ENST ID: ENST00000265316
  CDS Start-End: 318-2846
ccgtggagcgcggtgcgagtccaacaccgagcattcccgtgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtgcgag

SEQ ID NO: 110105 - DNA, 2238 bp, Homo sapiens
  Payload ID: 1615
  Gene Symbol: ABCB6
  Gene Name: ATP-binding cassette, sub-family B (MDR/TAP), member 6 (Langereis blood group)
  ENST ID: ENST00000295750
  CDS Start-End: 1-2072
tacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattgtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacaggtgacccaggcctctctccggtctcacattggagttgtgccccaagacactgtcctctttaatgacaccatcgccgacaatatccgttacggccgtgtcacagctgggaatgatgaggtggaggctgctgctcaggctgcaggcatccatgatgccattatggctttccctgaagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 110106 - DNA, 793 bp, Homo sapiens
  Payload ID: 1615
  Gene Symbol: ABCB6
  Gene Name: ATP-binding cassette, sub-family B (MDR/TAP), member 6 (Langereis blood group)
  ENST ID: ENST00000417678
  CDS Start-End: 1-443
aggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccagtgaacttgctgactgagaaggcaccttggaactctctggcctggactgttaccagttacgtcttcctcaagttcctccaggggggtggcactggcagtacagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccg

SEQ ID NO: 110107 - DNA, 544 bp, Homo sapiens
  Payload ID: 1615
  Gene Symbol: ABCB6
  Gene Name: ATP-binding cassette, sub-family B (MDR/TAP), member 6 (Langereis blood group)
  ENST ID: ENST00000452545
  CDS Start-End: 1-207
aacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccagtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcat

SEQ ID NO: 110108 - DNA, 882 bp, Homo sapiens
  Payload ID: 1615
  Gene Symbol: ABCB6
  Gene Name: ATP-binding cassette, sub-family B (MDR/TAP), member 6 (Langereis blood group)
  ENST ID: ENST00000448398
  CDS Start-End: 1-358
cggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcagccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatggg

SEQ ID NO: 110109 - DNA, 679 bp, Homo sapiens
  Payload ID: 1615
  Gene Symbol: ABCB6
  Gene Name: ATP-binding cassette, sub-family B (MDR/TAP), member 6 (Langereis blood group)
  ENST ID: ENST00000443805
  CDS Start-End: 1-122
tcgccgacaatatccgttacggccgtgtcacagctgggaatgatgaggtggaggctgctgctcaggctgcaggcatccatgatgccattatggctttccctgaagaaacgtgtggtgggtaatatccacagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggac

SEQ ID NO: 110110 - DNA, 2377 bp, Homo sapiens
  Payload ID: 1616
  Gene Symbol: ABCB7
  Gene Name: ATP-binding cassette, sub-family B (MDR/TAP), member 7
  Uniprot ID: O75027
  ENST ID: ENST00000253577
  CDS Start-End: 26-2287
ctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagcagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattccca

SEQ ID NO: 110111 - DNA, 2234 bp, Homo sapiens
  Payload ID: 1616
  Gene Symbol: ABCB7
  Gene Name: ATP-binding cassette, sub-family B (MDR/TAP), member 7
  Uniprot ID: O75027
  ENST ID: ENST00000339447
  CDS Start-End: 8-2146
gctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaaggggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcc

SEQ ID NO: 110112 - DNA, 2353 bp, Homo sapiens
  Payload ID: 1616
  Gene Symbol: ABCB7
  Gene Name: ATP-binding cassette, sub-family B (MDR/TAP), member 7
  Uniprot ID: O75027
  ENST ID: ENST00000373394
  CDS Start-End: 9-2267
cgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacatt

SEQ ID NO: 110113 - DNA, 550 bp, Homo sapiens
  Payload ID: 1616
  Gene Symbol: ABCB7
  Gene Name: ATP-binding cassette, sub-family B (MDR/TAP), member 7
  ENST ID: ENST00000526404
  CDS Start-End: 36-550
agaagggagtgaagataagaatatgcatagggaaaatggagagaggggagcgtgacattgagttggaggagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagcagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttccctt

SEQ ID NO: 110114 - DNA, 580 bp, Homo sapiens
  Payload ID: 1616
  Gene Symbol: ABCB7
  Gene Name: ATP-binding cassette, sub-family B (MDR/TAP), member 7
  ENST ID: ENST00000534524
  CDS Start-End: 15-580
tttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcag

SEQ ID NO: 110115 - DNA, 2116 bp, Homo sapiens
  Payload ID: 1616
  Gene Symbol: ABCB7
  Gene Name: ATP-binding cassette, sub-family B (MDR/TAP), member 7
  ENST ID: ENST00000529949
  CDS Start-End: 11-2116
ctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccaggctctccaggtatggccactgatagaaaagaggacatgttggcatggtcatgcaggaggaggactccacacagacccaaaagaagggttaaaagatgttgatactcggaaaatcataaaagcaatgctttcttatgtgtggcccaaagacaggccagatctacgagctagagttgccatttcgctgggatttttgggtggtgcaaaggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatcc

SEQ ID NO: 110116 - DNA, 2408 bp, Homo sapiens
  Payload ID: 1616
  Gene Symbol: ABCB7
  Gene Name: ATP-binding cassette, sub-family B (MDR/TAP), member 7
  ENST ID: ENST00000620875
  CDS Start-End: 69-2210
aggtagccgaattcagtccgccagtgtcccataatcctcttctctcggttcctctttcctcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagcagattccagagtcattaaaaagtatcacatggcagagattgggaaaaggcaattcaggacagttcttagatgctgcaaaggctctccaggtatggccactgatagaaaagaggacatgttggcatggtcatgcaggaggaggactccacacagacccaaaagaaggggccatgaatattgtggttcccttcatgtttaaatatgctgtagacagcctcaaccagatgtcgggaaacatgctgaacctgagtgatgcaccaaatacagttgcaaccatggcaacagcagttctgattggctatggtgtatcaagagctggagctgctttttttaacgaagttcgaaatgcagtatttggcaaggtagcccagaattcaatccgaagaatagccaaaaatgtctttctccatcttcacaacctggatctgggttttcacctgagcagacagacgggagctttatctaaggctattgacagaggaacaaggggtatcagttttgtcctgagtgctttggtatttaatcttcttcccatcatgtttgaagtgatgcttgtcagtggtgttttgtattacaaatgcggtgcccagtttgctttggtaacccttggaacacttggtacatacacagcattcacagttgcagtcacacggtggagaactagatttagaatagaaatgaacaaagcagataatgatgcaggtaatgctgctatagactcactgctgaattatgaaactgtgaagtattttaataatgaaagatatgaagcacagagatatgatggatttttgaagacgtatgagactgcttcattgaaaagtacctctactctggctatgctgaactttggtcaaagtgctattttcagtgtcggtttaacagctataatggtgctcgccagtcagggaattgtggcaggtacccttactgttggagatctagtaatggtgaatggactgctttttcagctttcattacccctgaactttctgggaactgtatatagagagactagacaagcactcatagatatgaacaccttgtttactctactcaaggtagacacccaaattaaagacaaagtgatggcatctccccttcagatcacaccacagacagctaccgtggcctttgataatgtgcattttgaatacattgagggccagaaagtccttagtggaatatcctttgaagtccctgcaggaaagaaagtggccattgtaggaggtagtgggtcagggaaaagcacaatagtgaggctattatttcgcttctatgagcctcaaaagggtagcatttatcttgctggtcaaaatatacaagatgtgagcctggaaagccttcggagggcagtgggagtggtacctcaggatgctgtcctcttccataatactatttattacaacctcttatatggaaacatcagtgcttcacctgaggaagtgtatgcagtggcaaaattagctggacttcatgatgcaattcttcgaatgccacatggatatgacacccaagtaggggaacgaggactcaagctttcaggaggagaaaagcaaagagtagcaattgcaagagccattttgaaggaccccccagtcatactctatgatgaagctacttcatcgttagattcgattactgaagagactattcttggtgccatgaaggatgtggtcaaacacagaacttctattttcattgcacacagattgtcaacagtggttgatgcagatgaaatcattgtcttggatcagggtaaggtagccgaacgtggtacccaccatggtttgcttgctaaccctcatagtatctattcagaaatgtggcatacacagagcagccgtgtgcagaaccatgataaccccaaatgggaagcaaagaaagaaaatatatccaaagaggaggaaagaaagaaactacaagaagaaattgtcaatagtgtgaaaggctgtggaaactgttcgtgctaagtcacataagacattttctttttttgttgttttggactacatatttgcactgaagcagaattgttttattaaaaaaatcatacattcccattttctataatccttcttttagataagatttatttaaaaggggatttgagttttacatctttcatagtctatttaatgtggcatctgtatttatccccaaattatttt

SEQ ID NO: 110117 - DNA, 2487 bp, Homo sapiens
  Payload ID: 1617
  Gene Symbol: ABCB8
  Gene Name: ATP-binding cassette, sub-family B (MDR/TAP), member 8
  Uniprot ID: Q9NUT2
  ENST ID: ENST00000297504
  CDS Start-End: 67-2274
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagaaacacatggcgtaatgggaaaactggacagttacacaaggcagaaggagagtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 110118 - DNA, 4683 bp, Homo sapiens
  Payload ID: 1617
  Gene Symbol: ABCB8
  Gene Name: ATP-binding cassette, sub-family B (MDR/TAP), member 8
  Uniprot ID: Q9NUT2
  ENST ID: ENST00000358849
  CDS Start-End: 94-2250
gttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccacgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaagcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataa

SEQ ID NO: 110119 - DNA, 537 bp, Homo sapiens
  Payload ID: 1617
  Gene Symbol: ABCB8
  Gene Name: ATP-binding cassette, sub-family B (MDR/TAP), member 8
  ENST ID: ENST00000461373
  CDS Start-End: 94-537
gttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggaggctcctgcgtctgcagccgcgtgtcagccagaaggaggggacgctcggggtcagtgaccacgcccagtccgcactcccgaccgggggtcccctttcctggccctggaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtg

SEQ ID NO: 110120 - DNA, 2350 bp, Homo sapiens
  Payload ID: 1617
  Gene Symbol: ABCB8
  Gene Name: ATP-binding cassette, sub-family B (MDR/TAP), member 8
  Uniprot ID: Q9NUT2
  ENST ID: ENST00000498578
  CDS Start-End: 55-2136
gtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccca

SEQ ID NO: 110121 - DNA, 552 bp, Homo sapiens
  Payload ID: 1617
  Gene Symbol: ABCB8
  Gene Name: ATP-binding cassette, sub-family B (MDR/TAP), member 8
  ENST ID: ENST00000488551
  CDS Start-End: 41-187
aaactgctattgccggcggctcctgttttaccgcgtcagcatgctggtgcatttatttcgggtcgggattcggggtggcccattcccaggcaggctgctaccgcccctccgcttccagacattctcagctgtcagctgtggagagggagtgtgtgtcatggcgccccaggccagggaggggaggtagggtaatgggcctgggacatcagaagacatggcacactggcagagtagagccagcctgggtgctggagtcagactgcagacttggttccctgctcgtcccagttctgctgcctgcggacaagttatttcagctctcttagctccacatgatttttttcatctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttg

SEQ ID NO: 110122 - DNA, 762 bp, Homo sapiens
  Payload ID: 1617
  Gene Symbol: ABCB8
  Gene Name: ATP-binding cassette, sub-family B (MDR/TAP), member 8
  ENST ID: ENST00000489192
  CDS Start-End: 79-255
gcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagtgacactccagtcgccagcaggaggctcctgcgtctgcagccgcgtgtcagccagaaggaggggacgctcggggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcga

SEQ ID NO: 110123 - DNA, 1994 bp, Homo sapiens
  Payload ID: 1617
  Gene Symbol: ABCB8
  Gene Name: ATP-binding cassette, sub-family B (MDR/TAP), member 8
  ENST ID: ENST00000482309
  CDS Start-End: 91-210
gtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcct

SEQ ID NO: 110124 - DNA, 1596 bp, Homo sapiens
  Payload ID: 1617
  Gene Symbol: ABCB8
  Gene Name: ATP-binding cassette, sub-family B (MDR/TAP), member 8
  ENST ID: ENST00000477092
  CDS Start-End: 50-1345
atgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagcttcctccgtgttgcaccctgtccgaattcccttccgctgcaggctgtgacattccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaa

SEQ ID NO: 110125 - DNA, 1625 bp, Homo sapiens
  Payload ID: 1617
  Gene Symbol: ABCB8
  Gene Name: ATP-binding cassette, sub-family B (MDR/TAP), member 8
  ENST ID: ENST00000477719
  CDS Start-End: 53-1282
gggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcaggtactctgatggctaccgcagctcctccctcctccgggccgtggcccacctgcggtcccagctctgggcccacctccctcgagcccccctagctcccagatggagcccctctgcctggtgctgggttgggggagccctgctaggccccatggtactgagtaagcatccccacctctgccttgtggccctgtgtgaggcagaagaggcccctcctgccagctccacaccccatgtcgtggggtctcgctttaactggaagctcttctggcagtttctgcacccccacctgctggtcctgggggtagccgtcgtgctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaagggacgtcctctaagtggagtcagactatgtccttttgtgactgcgttttgtcactccacattgtgtcctcagcttcctccgtgttgcaccctgtccgaattcccttccgctgcaggctgtgacattccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaaca

SEQ ID NO: 110126 - DNA, 717 bp, Homo sapiens
  Payload ID: 1617
  Gene Symbol: ABCB8
  Gene Name: ATP-binding cassette, sub-family B (MDR/TAP), member 8
  ENST ID: ENST00000491920
  CDS Start-End: 1-421
gtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggctgtgacattccatgcatggaaggaccatccttgacaggctgtgtgagctgcccttccccatgcctgccacttccagggatgacaagctgacccctgtccccacacaccccacccttatagcttattgctttgcgttggtccaaaaccacccgctcagctgagcctctgggatgaccagagctgatcaccagacagctcaaggcgggcctcccccctcctatctctttccaagctaaacacaagcagttctacataaatatgttatggtaaataatgagatagtaaatatgctgtaacagat

SEQ ID NO: 110127 - DNA, 1722 bp, Homo sapiens
  Payload ID: 1617
  Gene Symbol: ABCB8
  Gene Name: ATP-binding cassette, sub-family B (MDR/TAP), member 8
  ENST ID: ENST00000470645
  CDS Start-End: 67-213
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctgtggagagggagtgtgtgtcatggcgccccaggccagggaggggaggtagggtaatgggcctgggacatcagaagacatggcacactggcagagtagagccagcctgggtgctggagtcagactgcagacttggttccctgctcgtcccagttctgctgcctgcggacaagttatttcagctctcttagctccacatgatttttttcatctgtcagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcaggtaccggcattcctggccatcctcttcaccctccccacaccgtttctctttccactccccggaactcctccctgtccccatcctggactccttgtcctgttttctggactccttgtcctgtttcctggactccttgcagatcgccagggcaatgggcgtagcagacgaggccctgggcaatgtgcggactgtgcgtgccttcgccatggagcaacgggaagaggagtgagtcctgggagggcggagcacaaagcagagatgccccccacaccctgccaacccttcgtgccagcccagctgcctcctgaatgcactggtctctctcaccaggcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcaggtcagcacggctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaag

SEQ ID NO: 110128 - DNA, 2199 bp, Homo sapiens
  Payload ID: 1617
  Gene Symbol: ABCB8
  Gene Name: ATP-binding cassette, sub-family B (MDR/TAP), member 8
  ENST ID: ENST00000466514
  CDS Start-End: 67-186
atagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccaggtacagccgggagtggggctggggaccgccgaggagccacccgaggcatccctgagtgcactgggctctttcgcagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctccc

SEQ ID NO: 110129 - DNA, 4371 bp, Homo sapiens
  Payload ID: 1617
  Gene Symbol: ABCB8
  Gene Name: ATP-binding cassette, sub-family B (MDR/TAP), member 8
  Uniprot ID: Q9NUT2
  ENST ID: ENST00000542328
  CDS Start-End: 46-1938
ggttgtcgggatgggggcgggagccaacatagagccctcagtgggatgagggtgaaactgctattgccggcggctcctgttttaccgcgtcagcatgctggtgcatttatttcgggtcgggattcggggtggcccattcccaggcaggctgctaccgcccctccgcttccagacattctcagctgtcagctggccttgggtgcggcactcgtgaatgtacagatccccctgctcctgggccagctggtagaggtcgtggccaagtacacaagggaccacgtagggagtttcatgactgagtcccagaatctcagcacccacctgcttatcctctatggtgtccagggactgctgaccttcgggtacctggtgctgctgtcccacgttggcgagcgcatggctgtggacatgcggagggccctcttcagctccctgctccgacaagacatcaccttctttgacgccaataagacagggcagctggtgagccgcttgacaactgacgtgcaggagtttaagtcatccttcaagcttgtcatctcccaggggctgcgaagctgcacccaggtggcaggctgcctggtgtccctgtccatgctgtcgacacgcctcacgctgctgctgatggtggccacaccagccctgatgggagtgggcaccctgatgggctcaggcctccgaaaattgtctcgccagtgtcaggagcagatcgccagggcaatgggcgtagcagacgaggccctgggcaatgtgcggactgtgcgtgccttcgccatggagcaacgggaagaggagcgctatggggcagagctggaagcctgccgctgccgggcagaggagctgggccgcggcatcgccttgttccaagggctttccaacatcgccttcaactgcatggtcttgggtaccctatttattgggggctcccttgtggccggacagcagctgacagggggagacctcatgtccttcctggtggcctcccagacagtgcaaaggtccatggccaacctctctgtcctgtttgggcaggtggtccgggggctgagtgcaggtgcccgggtctttgagtacatggccctgaacccctgcatcccactgtctgggggctgctgcgtccccaaagagcagctgcgtggctccgttacatttcagaacgtctgcttcagctacccctgccgccccggcttcgaggtgctgaaagacttcaccctgacgctgccccctggcaagatcgtggccctcgtgggccagtctggcggaggaaagaccaccgtggcttccctgctggagcgcttctacgaccccacggcaggcgtggtgatgctggatgggcgggacctgcgcacccttgacccctcctggctccggggccaggttgtcggcttcatcagccaggagcccgtcctgtttgggacgaccatcatggaaaacatccgctttgggaagctggaagcttccgatgaagaggtgtacacagccgcccgggaagcgaatgctcacgagttcatcaccagcttccccgagggctacaacacggtcgtcggtgaacggggcactaccctgtctgggggccagaagcagcgcctggccatcgcccgagcccttatcaagcagcccacggtgctgatactggatgaagctaccagcgcgctggatgcagagtccgagcgggttgtacaggaggccctggaccgggccagtgcaggccgcacggtgctggtaattgcccaccggctcagcactgtccgtggggcccactgcattgtcgtcatggccgatggccgtgtctgggaggctgggacacatgaagagctcctgaagaaaggcgggctatacgccgagctcatccggaggcaggccctggatgccccgaggacagcggccccaccgcccaaaaagccagaaggccccaggagccaccagcacaagtcctgagaagggccccctgaggtgtggtcgctgccaagcatcagtgttagggctggggctcagcctgggggagcctactggggactgagcccccaggagggccagcatgtggagagtcgctgcggctgctcctgctcacaataaagccggggccgagcagctggcaggggaggccaatccctccctcccctccccagtcctgccggctgcctccctcccaccagagtctgccagagtcattgggctgcaatgggcagagacagagttccacgagacacctccactctattctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctgcacagtgaacacagtcctgatttctagatttcacctcccctccccacccacaagggacacaggcctaacagggcccaacacttgggtcagggtaggagggacggggccacaatggccagttcccacgagaagcgccagcctgcctggctgtcttccaccggccctgccctgtgtgcctggcgtctttcacccactgagattgtgaaccagcctccatctacaccaagaacacccagcactgaaggagatgggaggggctgatgcccacctggagctctctgcttcctgcccacagtgctgacgagtacagagctaaatggagcagctactgcagaatccagtacagaatcggtccaggagggtgcggctgtggacaggccagcatccccagcaggttctgggaggcgcaccttgaaaggggaaggcagacatcctgagtgatgggcgcctgtggccctgagactgtggatgagggggctaggctccagctggcttctgaggggcctggaaaggcacacaagtaggtccttggctgaactggtgccccagcaggacctcgtgtccctgcactgctgcagatgcatcagccctccccatgttggtgccgctgtcacttcctactgggatccttcccctatccagccacatccaggctgtgggactacacggtgccctgttcccctgggcaggagaagaggtggtacctgcaatgcaccttcacagccaggcaagcattctggatttaccctgtgtaaagaagggtggtaccctctttcaggggtgtgatacagtgcattgatggagcagctggtgctgctgggaggccagcctggaagaggcagcagtggctcaagtttgcgtgcaggagccagagtgggacccacgggctcttgtgggtgtggtttagaactagatggtgctttggggacaagccatccaaaaaccccaggcccacatccaccctgatttgatatcccacttcctgacagatcagaggctgtgtctttaagcagtggaggtccaggagcagagcctggggctggttcacagctaaacccctccttagggcagcccagagtagggcctcagctggcaagtccacaagccctgctggggccctgcttgttggcctgacccctccctcaccaggcagccagccaaggtggttcctgcttcacccactcagtcatcagcctcaggctgcccaaaatgcctctgacaccagatttatatcttctgggcggcttctttaaatccagcccttcacccgccccctagagaagcagtgaaaccccttggctagtccagctggaagagctagaccgcaggagccgcgccgtcttcctaacctcgcctcggccttcgctccacagtggagagtgggagcctagctgtgcttgatgctgaatgcctgttttgagagtgtgagtgggatcatctacagtaaatacttgcaaagcatggcactgtggctctggggagctggtacgcctgtgctgtaaccatggtactcagtccttccaaagtgtttattaatcaagcacctgtcatgtgccattgagcccacgatggggaatgaggacagtccctgcccccatgaagcttgtgtcctgttgggaggacagacaggtggcccagcagttgcagcatggtgtgtgcacacgtttggctggtggaaccatgtttctaccactcatggtcaaaaaaagcccaccaaagtcctgggagttcacatctgtgtgatgatacggcaacattgtttgtaatggaaagactggacacccccagtgcccatcagtgggggagtcattaaataaactatggtatgtgcacataa

SEQ ID NO: 110130 - DNA, 3399 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000346530
  CDS Start-End: 311-2482
gtcactgaggccccgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccct

SEQ ID NO: 110131 - DNA, 3517 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000280560
  CDS Start-End: 298-2598
cgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccctaa

SEQ ID NO: 110132 - DNA, 3791 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000392439
  CDS Start-End: 579-2879
cacgcccccaaccgcgggaggcgcggaaccagcggccaaggggccgctctaagttcccaagggcggaaaaggacgaagacgcacctcgccaggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctta

SEQ ID NO: 110133 - DNA, 3799 bp, Homo sapiens
  Payload ID: 1618
  Gene Symbol: ABCB9
  Gene Name: ATP-binding cassette, sub-family B (MDR/TAP), member 9
  ENST ID: ENST00000442028
  CDS Start-End: 579-2888
cacgcccccaaccgcgggaggcgcggaaccagcggccaaggggccgctctaagttcccaagggcggaaaaggacgaagacgcacctcgccaggaaacggtctgcggagaaagatgctcctgggccgggttgggaccggcggcctcctcgttccgcctcccagttttcccactacgaggcagggactaatggctccactttacagacagctgaactgggtcgtgccttcacaggacggggagaggaagggactcggagccccaaggcctttgacttaaacgccgacccaccccccgccgtctgcccggagctcgtggagaaccagccgagctgaggacagtttaaagagctcggaggtccgactagttcccgctggtgcttcaatcatccagccctgtacgtttcagtttggatttagcatctaccccgggtccctgcctggcgcttccggtccctccgccacagtctgttggattacctcagattgccccagcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgtccccgcagatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctt

SEQ ID NO: 110134 - DNA, 2134 bp, Homo sapiens
  Payload ID: 1618
  Gene Symbol: ABCB9
  Gene Name: ATP-binding cassette, sub-family B (MDR/TAP), member 9
  ENST ID: ENST00000426173
  CDS Start-End: 1-438
gggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcaggtattcggggcggcatttttaccctcatatttgccagactgaacattcgccttcgaaactgtctcttccgctcactggtgtcccaggagacaagcttctttgatgagaaccgcacagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctggtgagtcacagggtggtgggcaatgcgggggcaggagcggctccaggtggccagagcccccatcgcccagcagatggatgctgagaagagacgggccccaggagctctcccagactatcagcctcctgggctggtgaattcctggtgttgagagtggggagccaggagccactctggacccagcctccaggctccaggcagagctgtatggtgtggggcaagagaaggcatcagaatggggagacctgggtcatgagtggtggcttacacctgtaatcccagcactttgggaggccgaagcaggtggatcacctgaggtcaggagttgcagaccagcctggccaacatggtgaaaccccatctctactagaaatacaaaaactagccaggtgtggtagcacatgcctataatcccagctacttgggaggctgaggcaggagaattgcttgaacctgggaagtggaggttgcagtcagccgagattgtgccactgcactccagcctgggcgacagagccagactccatctggctcaaacaaacagacaaaacaaaacaaaataaaataggcccagtatgatggctcatgcctataatcccagcactttgggaggccaaggcaggtggatcacttgaggtccggagttcgagacaagcctggtcaatacagtgaaaccctgtctctactaaaaatacaaaaattagctgggcatggtggtgcatgcctgtaaccccagctactcgggaggctgaggcaggagactcacttgaacccgggagatggaggttgcagtgagctgagattgtgccactgcactctagcctgggcgacagagtgagactccatctacaaaaaaaaaaaaaaaa

SEQ ID NO: 110135 - DNA, 2591 bp, Homo sapiens
  Payload ID: 1618
  Gene Symbol: ABCB9
  Gene Name: ATP-binding cassette, sub-family B (MDR/TAP), member 9
  ENST ID: ENST00000537276
  CDS Start-End: 204-1022
agagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctggtgagtcacagggtggtgggcaatgcgggggcaggagcggctccaggtggccagagcccccatcgcccagcagatggatgctgagaagagacgggccccaggagctctcccagactatcagcctcctgggctggtgaattcctggtgttgagagtggggagccaggagccactctggacccagcctccaggctccaggcagagctgtatggtgtggggcaagagaaggcatcagaatggggagacctgggtcatgagtggtggcttacacctgtaatcccagcactttgggaggccgaagcaggtggatcacctgaggtcaggagttgcagaccagcctggccaacatggtgaaaccccatctctactagaaatacaaaaactagccaggtgtggtagcacatgcctataatcccagctacttgggaggctgaggcaggagaattgcttgaacctgggaagtggaggttgcagtcagccgagattgtgccactgcactccagcctgggcgacagagccagactccatctggctcaaacaaacagacaaaac

SEQ ID NO: 110136 - DNA, 2108 bp, Homo sapiens
  Payload ID: 1618
  Gene Symbol: ABCB9
  Gene Name: ATP-binding cassette, sub-family B (MDR/TAP), member 9
  ENST ID: ENST00000541424
  CDS Start-End: 1672-2108
acaaaggtctctgctagcggctcaatcatgcaggtccttgtgggctattgtaaagactttggcttttaccatctcactggatgagaagggggatttggactgttttgagccaaggagcaacaagatctgaagttagttccaacaggatcctgccttctactgtgtggacaggctgatgtgagcaaagttgagagcaggctactgagatagtcccagtgaggttaatgacttggaccagggttggggcagtagaggcagtgaaagtggtcaggttctggaaatggtctgagtatttgctggtgcattggagagtttcacgtaattcttgtgcagattcagcaagagagtttgccggcatgctttgcacagcccctggtacccagtaaggcgattattagcattggtgcttgctggaatcagatattccagaatattctgtcacagctcatcgttgccctcttcttttctgtgggtaaactgaggcagaaactcaggctgggtggaactctgcagcctcagctggagacctcgtctggccaaggactgtggggacacaggccctctaggctgccacctcatggtcccagcagagggcaccagaactgcacagaaagtctcactacccaagtgtctgagccaggccagactgtgctagccagacctgcccggggttcattcactgacctttattgagcacctactgtatgcccagccccaaacctggctctgctcatggaaagaacttcagtggaaacaggtcctgggatgaacaagggcctggcctggcctggtgatgccactatttccttaagaggagagtggacattccggattattgtcgggggagtctcatttctgctgctgtaacaaaataccacagactgggtcatttagaaaccatagaaactgatttcgtactgttctagaggctgggaagtcccagatcaaggtgccagcaggtttggtgtcgtgagggccactctctgcttccaagatggtccctccttgctgtgtcctctggaggggaagactgctgtgtcctcacgctgcagaaggtggaagggcgagagatggcaaaccaggcttacaagccctttgaaaagggccctcatcccatcctggagagctctgccctatcacattggcgattatgtttcaatatgtaaattttgggagatgcattcagaccacaggaggaagggaaaagaaagagcccccaggttgaaagccagtttaggtttgagtcccagcctttccccttgctgtgtgacctggagtaaattcctcagcctctgtgagtctcccattccaccccaggattgttgtgaaaacacagtaaggcaagcgggtaagaaagcacccagcaaggtgtcaagtgccccaccaggaggggtggggtggcaatttccagcattgcttggaaccagaatagcaacgtcttctgaggttccagaatttggactctgaacccattgagaagaatgaaatcaactttggcgtcaatcagccactgattgccatgtggcctggacgagtcatctcattcaacttcactttcagccggacgctgtgactcaggcctgtaaccccagcactttgggaagctgaggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacac

SEQ ID NO: 110137 - DNA, 1104 bp, Homo sapiens
  Payload ID: 1618
  Gene Symbol: ABCB9
  Gene Name: ATP-binding cassette, sub-family B (MDR/TAP), member 9
  ENST ID: ENST00000542448
  CDS Start-End: 325-1104
cagcaccgtgccctatccttcaggagctgaaaccattgccccaagagcctctctggagttgactacctgagtgtgtcaaattgagccagaaggggatgggggagaaagggctagatcttgtctttttgtcctaggaacctcttgcatatagctggtgccagcgaagggtggaaaaacccagagaggcctgggggctccagtacatagtgaggctgttttggggtcttctccttcttgtccccctcctgtccatagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcaca

SEQ ID NO: 110138 - DNA, 6051 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000542678
  CDS Start-End: 2840-5140
gaagaggaggaggagctggatcttgttctcctccgggccttctgcttgcttctctctgtgatgcagggagaaggtgaggctggaaggccaggaggggaagaggtaaaccttcgtcccctgctctggcctggggcaggcacagaccggctacagggtgagcgcttcctgaggggctttccagaacagagatggagcttcccagaggagccccttcctggctcctgcggcgcctggccctcacatctcaggcccggctgcacagaggcatgactgagcgtccccgaccactgctcgcccgacttccccgggtagtaactgcgcctcctctccccgatgcctgtggtcctcaccctccgccccaggggccgtgctggccttgcgaccttgggatgtggaggccgagcagttcctcgaggtgtctttcctgctcttcttctttctcttttccgacccccgtccccgggaccggctgcgactcctcgagcgcttgcgggagccgacgtgagccatggcgccgcgggctggcgacgaagaagacgcgcttgagccgaagcccccaaggccggccgcgggcgggctccaagggtggctctagcggggccggggcctggcgacgcccagtacccgtcaccgtcccgggaaaatgagcgaccctcacccacccccagcgctggggaccccggttttctccgccgactccagtccccgcagcggtgcctgttaagggcccgccccgtgcccggaggccccacgcctgcgcacccggctccaaacccctgggaactggccgccgtccgccgcgagtggcgtctggggcgctttcccgcgctctcctaccctccagccccgcgcccttcgcggcctcgccgcctcaagggggcccccggggctgctccgttcccacctcgaccgccctgcgggccggacagcccgccccgcgccttctcgagaggaagcggcggcgaggaggcttccggccggggcgctgcgcgggaggctggccggctgggaagcgcggcgccgctgcctttcgttctgacgccccaggttccgtcccgggcgcgcccacctcccgcagaggcaagcaggggcgccggccctcgagctccgcagcccctcacgcctgtgtctgccgaagctgcgcccacttccaaggctgccctctcggcgcacgcccgcagcacccacgcccccggtgccctgggaagaaggcgaccctcgcgcgcgccgccctcctccccggctggtcctgccctctccatacgactgcgagctccagactgaggcgccctggtctttccgacgcgcccacccagtgactcagaggtcgcaaactcgtgtccgtaggggccagaaagatcttggcagtgagcgcgggcatggaccccaggcccatccggaaggaagccaggattctgctccagctgatacgtgcaacgtggcatggggctggtgccccaccttcccagggagaccaaactcaagactgcaatatggaagccccctgagtttcaaatgtgtaacccaaagcgtggctgtgcgcttcatccaatctcgggcccccaagttgcaactcttccacaatgacagccgcaaacacaaagggatcttgcaaagcactttatatacgtcagcgcatttgactcccaaaacagctctaggaggtaggtgctaaatgaggaaacgaaggcaccaaaaggtgaaggctcacctaaagccacacagctggaagtggcagaagcagaatgggaacccgggcagcctggttcctggccctgccattcacccctctgccatctagaagatgctactggtggcccacccgagtccactggggggtgatgcctgctgctgagggttcacatctgtgctctctggaggcttcccttggctactggaaggcaccctgccctggagataagtgtctgggaagttattcactcctctctggccccctcatccaggagccagtaaccggtggtgtgggcacactgtggtactgtgggctctgcctggagctctccgtggggccagctgaggctggacgtcctctgaagccacttccttgcccagctgctccctcccctcccctgcttccctgactccctcgctgaagccccattccagaccctgcttctgacaaacctgaactaaggcagcatctttgcccatagaatgacccagaagctggcacaccgttgagccaagaagtgcagtaggctgcggggattttatttctgcccccagaccaaggcaacggagccctcacctgcctgccacccccacactgggcccaagcaagctcaggtgagcgcacatacatccaccgtggcgggctcctctcgggtgaagccatcaccgaagccctcatcgtccaccaggtcgggctcacggcagcacatgggacagaggctgttgcgcacagcagaggctcggagccagacgacaaggttccaacgctcaccagtgcccaagggccgggctccatgcagctggccgccacggtggaggacaccctggcccaccacgtgctccacctccaggggctccgtcagggctgtgggtgcctgcagatggcacgactcaggcctgggcactcacagctgccccaggccctgccgcatgggtcacacactcacctggaagaggcccccaaaatacagggcgccccctgtgaagaccttgcccaaggccacattgagggtgagctcggcattatcatagtggcagcccagctccaggtcctggcccggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctctt

SEQ ID NO: 110139 - DNA, 1066 bp, Homo sapiens
  Payload ID: 1618
  Gene Symbol: ABCB9
  Gene Name: ATP-binding cassette, sub-family B (MDR/TAP), member 9
  ENST ID: ENST00000540971
  CDS Start-End: 519-1066
cttgtctgtaaaatgggaacacggatagtagccaccccatggggtccttacacagctcttagcacaatgtccaacttaggtaagaagtgtctgcgctttcctgcccgccaccagccaggttgttatttccctagaagggaagaggagttaccccctctgccagtgacagggaggagacatgggtttgaagtctggctcagtcacggacaggctgtgtgactctacgggggccttcctgttctgagccccagcctcctccgctgtacagcgggatgtcatgaagcttaagcaagatgctgatgactgggattggctcagagtagccctcgaggggtatctgctcttctcccccaccccccaaccccgcccacaggtagggaggcccggcttcccagtgtctgtctcagaggccccttagcatcccccaccgccacccccaaggcccgggttgctgtggtgagagctgagccgcgtgtgttccaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctga

SEQ ID NO: 110140 - DNA, 3330 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000540285
  CDS Start-End: 302-2413
gccccgccccgtccatcagcctgtctcaacgcacgccagtctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctctacgccaagctggtgcagcggcagatgctggggcttcagcccgccgcagacttcacagctggccacaacgagcctgtagccaacggcagtcacaaggcctgatggggggcccctgcttctcccggtggggcagaggacccggtgcctgcctggcagatgtgcccacggaggcccccagctgccctccgagcccaggcctgcagcactgaaagacgacctgccatgtcccatggatcaccgcttcctgcatcttgcccctggtccctgccccattcccagggcactccttacccctgctgccctgagccaacgccttcacggacctccctagcctcctaagcaaaggtagagctgcctttttaaacctaggtcttaccagggtttttactgtttggtttgaggcaccccagtcaactcctagatttcaaaaacctttttctaattgggagtaatggcgggcactttcaccaagatgttctagaaacttctgagccaggagtgaatggcccttccttagtagcctgggggatgtccagagactaggcctctcccctttacccctccagagaaggggcttccctgtcccggagggagacacggggaacgggattttccgtctctccctcttgccagctctgtgagtctggccagggcgggtagggagcgtggagggcatctgtctgccatcgcccgctgccaatctaagccagtctcactgtgaaccacacgaaacctcaactgggggagtgaggggctggccaggtctggaggggcctcaggggtgcccccagcccggcacccagcgctttcgcccctcgtccacccacccctggctggcagcctccctccccacacccgcccctgtgctctgctgtctggaggccacgtggatgttcatgagatgcattctcttctgtctttggtggatgggatggtggcaaagcccaggatctggctttgccagaggttgcaacatgttgagagaacccggtcaataaagtgtactacctcttacccct

SEQ ID NO: 110141 - DNA, 917 bp, Homo sapiens
  Payload ID: 1618
  Gene Symbol: ABCB9
  Gene Name: ATP-binding cassette, sub-family B (MDR/TAP), member 9
  ENST ID: ENST00000546289
  CDS Start-End: 85-917
gacaagccttggaagacacccctgccaacggccggcatttcagtttgtggctgggtctgccctcacctccccctgcagcctgggatgggtcagggaatggggatggtgggggatctaaggtcccctcgacccacatcccctctccctctgccccagctcacactgctggtggtccaggtcagcatcctctactacgggggccaccttgtcatctcaggccagatgaccagcggcaacctcatcgccttcatcatctacgagtttgtcctgggagattgtatggagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatccagcaggccatccatggcaacctgcagaagcacacggtactcatcatcgcgcaccggctgagcaccgtggagcacgcgcacctcattgtggtgctggacaagggccgcgtagtgcagcagggcacccaccagcagctgctggcccagggcggcctcta

SEQ ID NO: 110142 - DNA, 1419 bp, Homo sapiens
  Payload ID: 1618
  Gene Symbol: ABCB9
  Gene Name: ATP-binding cassette, sub-family B (MDR/TAP), member 9
  ENST ID: ENST00000546077
  CDS Start-End: 1073-1419
atccccttaggaggggctcagggggccactaagggctagtgaaggacaggtcttgaggctgtgtttgcattcattcattcatttcttcgctcattcaataaataattattgaccacctgctatgtcccaggcactgggatacatcagtgaaaaagacaaggcccctgccttcctggaacttgtatctagtgtcagagacagatactaggtaccaacagcataaagaatgagaatccacaatacagtaaaagatggtcagtgctaaggagaaacatgaagtgagcagagggattgggagcattgggtgtagctgcaattttaaattggatttactggctgggcccggtggctcatgcctgtaatcccagaactttgggaggcacaggcaggaggaccacttgagcctaggagttcgagacaagattggacaatatagcaagaccccatctctacaaaaaaaaattttttttagttagctgggcttggtggcgcatgcctgtggtcccagctacctgggatgctgaggtggaggatcgcctgagcccaggaggtcgaggctgtagtgagcaatgatcgtgccactatactctagcctgggtgacacagcaagaccctgtctctaaaatgaatgaataaatacaagttaaataggtcttgctgagaaggggacatctgaataagggtctgaaggaggcgggcatcttgggaggtatgtgctgagcagagggcacagccagtgaaaaggccctgggttggaacgtgcctggtgtgtatgtgggggtggtgcgggcccgctgtgatgccatcgcgggcccgctgtgatgccatcatgggcaggctgctgtcccctctggccaccccacggcactgcttctgcttccgagctagggccgtgagccaggtttgacctcaccctcctcctgcttcctgaatgggcgggtgcccccgagccctaagggacagacaggctgggttcagacaggcagggctgtgaccctgtgacaggtacaggcaaccccctcacagtcacccaggcccacgtggggtacttctagagcaggggcttggatgcatgacggcctccaggtggtgccggaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtat

SEQ ID NO: 110143 - DNA, 568 bp, Homo sapiens
  Payload ID: 1618
  Gene Symbol: ABCB9
  Gene Name: ATP-binding cassette, sub-family B (MDR/TAP), member 9
  ENST ID: ENST00000543935
  CDS Start-End: 372-568
attacttccggtggcgttcccaatggacgcgggagggcggggtcaggtgtgggagggcgacggggcgtggtctcaccgcagccaacaaatgacaactcttgcagaccgagcctcttctctccccggacctttgctcaggaatctaccagcattaaacctttgagctagacactctgggctcagtcaccgaagggagcagcagcaagaagaatatttaccagcaagtactgaatcaacatgtgctgccagccagcgctgacatgtatctttgttgactgcttaaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccat

SEQ ID NO: 110144 - DNA, 1168 bp, Homo sapiens
  Payload ID: 1618
  Gene Symbol: ABCB9
  Gene Name: ATP-binding cassette, sub-family B (MDR/TAP), member 9
  ENST ID: ENST00000536976
  CDS Start-End: 503-1168
gcctggcatggtggcacatgcctgtattccctactcaggaggctgagacaggaggatcacctgagcccaggagtttgatgctgcagtgagctatgattacaccactgcactccagcccgggggacacagcgagaccctgtctcaaaaaacaagagaatgaagcatcctgcaggagccctggctcgatgcctggtagccactataaataaagaagaaccagcaggctgtgtggatgcaaggcccagtgctcccctgttctctgaggaggggggcattaagcaccctggggccccacgatgggcagcaagagtttgccgagggaggaaagcccaccggtggagtgggcagaggggttggtgtgtggacttctggagcctcaggaggaagggtgcgggttcccctggctgcagacgtccctgaggctgccctgcctcccccaggagagaccttcctgccctactacacgggccgcgccattgatggcatcgtcatccagaaaagcatggatcagttcagcacggctgtcgtcatcgtgtgcctgctggccattggcagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggag

SEQ ID NO: 110145 - DNA, 549 bp, Homo sapiens
  Payload ID: 1618
  Gene Symbol: ABCB9
  Gene Name: ATP-binding cassette, sub-family B (MDR/TAP), member 9
  ENST ID: ENST00000545373
  CDS Start-End: 82-549
aagccttggaagacacccctgccaacggccggcatttcagtttgtggctgggtctgccctcacctccccctgcagcctgggatgggtcagggaatggggatggtgggggatctaaggtcccctcgacccacatcccctctccctctgccccagctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtc

SEQ ID NO: 110146 - DNA, 2587 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000442833
  CDS Start-End: 262-2313
ctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgtgtgctgggtaaaccaggagaaagtaattgcagtcgagggctttgggaacagcacagttggccagagagacagatgaggaaaacaagcagggatgagagagaatgaagaggagcacggcaccccagggctggcttagtcctggcgccaggacttagtttactctgtcattgtttctttcccacattagagtttgtcttcatcactgctgtattccccagtgcctagaacagtggctgacacatagtatgtgctcagtaaacagccattaaagaaatgtttgagctg

SEQ ID NO: 110147 - DNA, 2394 bp, Homo sapiens
  Payload ID: 1618
  Gene Symbol: ABCB9
  Gene Name: ATP-binding cassette, sub-family B (MDR/TAP), member 9
  Uniprot ID: Q9NP78
  ENST ID: ENST00000344275
  CDS Start-End: 262-2307
ctcagctccgaccttgcagcggcgcagcgcgggtgggaggcggggaggagcagcgggaagagcggagcgaggaccgcgtccggcgcagtcttcaatgagcagcgcggaaactgcaccccagacccgagcctgctgcgcgccccctcccagagctcacctggtgccaggtaacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggagagaccttcctgccctactacacgggccgcgccattgatggcatcgtcatccagaaaagcatggatcagttcagcacggctgtcgtcatcgtgtgcctgctggccattggcagctcatttgccgcaggtattcggggcggcatttttaccctcatatttgccagactgaacattcgccttcgaaactgtctcttccgctcactggtgtcccaggagacaagcttctttgatgagaaccgcacaggggacctcatctcccgcctgacctcggacaccaccatggtcagcgacctggtctcccagaacatcaatgtcttcctgcggaacacagtcaaggtcacgggcgtggtggtcttcatgttcagcctctcatggcagctctccttggtcaccttcatgggcttccccatcatcatgatggtgtccaacatctacggcaagtactacaagaggctctccaaagaggtccagaatgccctggccagagcgagcaacacggcggaggagaccatcagtgccatgaagactgtccggagcttcgccaatgaggaggaggaggcagaggtgtacctgcggaagctgcagcaggtgtacaagctgaacaggaaggaggcagctgcctacatgtactacgtctggggcagcgggctcacactgctggtggtccaggtcagcatcctctactacgggggccaccttgtcatctcaggccagatgaccagcggcaacctcatcgccttcatcatctacgagtttgtcctgggagattgtatggagtccgtgggctccgtctacagtggcctgatgcagggagtgggggctgctgagaaggtgttcgagttcatcgaccggcagccgaccatggtgcacgatggcagcttggcccccgaccacctggagggccgggtggactttgagaatgtgaccttcacctaccgcactcggccccacacccaggtcctgcagaatgtctccttcagcctgtcccccggcaaggtgacggccctggtggggccctcgggcagtgggaagagctcctgtgtcaacatcctggagaacttctaccccctggaggggggccgggtgctgctggacggcaagcccatcagcgcctacgaccacaagtacttgcaccgtgtgatctccctggtgagccaggagcccgtgctgttcgcccgctccatcacggataacatctcctacggcctgcccactgtgcctttcgagatggtggtggaggccgcacagaaggccaatgcccacggcttcatcatggaactccaggacggctacagcacagagacaggggagaagggcgcccagctgtcaggtggccagaagcagcgggtggccatggcccgggctctggtgcggaaccccccagtcctcatcctggatgaagccaccagcgctttggatgccgagagcgagtatctgatctgaatgaccagcctgcagatatcagaaccgagatggattgatgatgatgacaatgataaccattcaggtataaaacattttcagtgcagc

SEQ ID NO: 110148 - DNA, 6594 bp, Homo sapiens
  Payload ID: 1619
  Gene Symbol: ABCC1
  Gene Name: ATP-binding cassette, sub-family C (CFTR/MRP), member 1
  ENST ID: ENST00000399408
  CDS Start-End: 1154-4801
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 110149 - DNA, 6552 bp, Homo sapiens
  Payload ID: 1619
  Gene Symbol: ABCC1
  Gene Name: ATP-binding cassette, sub-family C (CFTR/MRP), member 1
  Uniprot ID: P33527
  ENST ID: ENST00000399410
  CDS Start-End: 176-4771
ccaggcggcgttgcggccccggccccggctccctgcgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgttcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgattttttttttttaagtactgttccggggagaaaaacagtctcaaaacttgaacttcttgggaatagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatatttta

SEQ ID NO: 110150 - DNA, 744 bp, Homo sapiens
  Payload ID: 1619
  Gene Symbol: ABCC1
  Gene Name: ATP-binding cassette, sub-family C (CFTR/MRP), member 1
  ENST ID: ENST00000572053
  CDS Start-End: 1-69
ctggtgacggacagtgcagggaagcaactgcagagatttgagggccacttccacctcactaggccttaactaaagacctttgcacagatctcatggacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttctt

SEQ ID NO: 110151 - DNA, 4565 bp, Homo sapiens
  Payload ID: 1619
  Gene Symbol: ABCC1
  Gene Name: ATP-binding cassette, sub-family C (CFTR/MRP), member 1
  ENST ID: ENST00000572882
  CDS Start-End: 1-4321
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggttgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccttgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcgtccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctgg

SEQ ID NO: 110152 - DNA, 6607 bp, Homo sapiens
  Payload ID: 1619
  Gene Symbol: ABCC1
  Gene Name: ATP-binding cassette, sub-family C (CFTR/MRP), member 1
  ENST ID: ENST00000622828
  CDS Start-End: 1166-4813
ccaggcggcgttgcggccccggccccggctccctgcgccgccgccgccgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggtcgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccctgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcatccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatattttatttctttctaaa

SEQ ID NO: 110153 - DNA, 4565 bp, Homo sapiens
  Payload ID: 1619
  Gene Symbol: ABCC1
  Gene Name: ATP-binding cassette, sub-family C (CFTR/MRP), member 1
  ENST ID: ENST00000621659
  CDS Start-End: 1-4321
ggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggtcgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccctgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggcagcacagtgatggacgaggaggaagcaggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcatccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctgg

SEQ ID NO: 110154 - DNA, 6518 bp, Homo sapiens
  Payload ID: 1619
  Gene Symbol: ABCC1
  Gene Name: ATP-binding cassette, sub-family C (CFTR/MRP), member 1
  Uniprot ID: P33527
  ENST ID: ENST00000621144
  CDS Start-End: 141-4736
cgccgccgccgccgccgccgccagcgctagcgccagcagccgggcccgatcacccgccgcccggtgcccgccgccgcccgcgccagcaaccgggcccgatcacccgccgcccggtgcccgccgccgcccgcgccaccggcatggcgctccggggcttctgcagcgccgatggctccgacccgctctgggactggaatgtcacgtggaataccagcaaccccgacttcaccaagtgctttcagaacacggtcctcgtgtgggtgccttgtttttacctctgggcctgtttccccttctacttcctctatctctcccgacatgaccgaggctacattcagatgacacctctcaacaaaaccaaaactgccttgggatttttgctgtggatcgtctgctgggcagacctcttctactctttctgggaaagaagtcggggcatattcctggccccagtgtttctggtcagcccaactctcttgggcatcaccatgctgcttgctacctttttaattcagctggagaggaggaagggagttcagtcttcagggatcatgctcactttctggctggtagccctagtgtgtgccctagccatcctgagatccaaaattatgacagccttaaaagaggatgcccaggtggacctgtttcgtgacatcactttctacgtctacttttccctcttactcattcagctcgtcttgtcctgtttctcagatcgctcacccctgttctcggaaaccatccacgaccctaatccctgcccagagtccagcgcttccttcctgtcgaggatcaccttctggtggatcacagggttgattgtccggggctaccgccagcccctggagggcagtgacctctggtccttaaacaaggaggacacgtcggaacaagtcgtgcctgttttggtaaagaactggaagaaggaatgcgccaagactaggaagcagccggtgaaggtcgtgtactcctccaaggatcctgcccagccgaaagagagttccaaggtggatgcgaatgaggaggtggaggctttgatcgtcaagtccccacagaaggagtggaacccctctctgtttaaggtgttatacaagacctttgggccctacttcctcatgagcttcttcttcaaggccatccacgacctgatgatgttttccgggccgcagatcttaaagttgctcatcaagttcgtgaatgacacgaaggccccagactggcagggctacttctacaccgtgctgctgtttgtcactgcctgcctgcagaccctcgtgctgcaccagtacttccacatctgcttcgtcagtggcatgaggatcaagaccgctgtcattggggctgtctatcggaaggccctggtgatcaccaattcagccagaaaatcctccacggtcggggagattgtcaacctcatgtctgtggacgctcagaggttcatggacttggccacgtacattaacatgatctggtcagcccccctgcaagtcatccttgctctctacctcctgtggctgaatctgggcccttccgtcctggctggagtggcggtgatggtcctcatggtgcccgtcaatgctgtgatggcgatgaagaccaagacgtatcaggtggcccacatgaagagcaaagacaatcggatcaagctgatgaacgaaattctcaatgggatcaaagtgctaaagctttatgcctgggagctggcattcaaggacaaggtgctggccatcaggcaggaggagctgaaggtgctgaagaagtctgcctacctgtcagccgtgggcaccttcacctgggtctgcacgccctttctggtggccctgtgcacatttgccgtctacgtgaccattgacgagaacaacatcctggatgcccagacagccttcgtgtctttggccttgttcaacatcctccggtttcccctgaacattctccccatggtcatcagcagcatcgtgcaggcgagtgtctccctcaaacgcctgaggatctttctctcccatgaggagctggaacctgacagcatcgagcgacggcctgtcaaagacggcgggggcacgaacagcatcaccgtgaggaatgccacattcacctgggccaggagcgaccctcccacactgaatggcatcaccttctccatccccgaaggtgctttggtggccgtggtgggccaggtgggctgcggaaagtcgtccctgctctcagccctcttggctgagatggacaaagtggaggggcacgtggctatcaagggctccgtggcctatgtgccacagcaggcctggattcagaatgattctctccgagaaaacatcctttttggatgtcagctggaggaaccatattacaggtccgtgatacaggcctgtgccctcctcccagacctggaaatcctgcccagtggggatcggacagagattggcgagaagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaagacgcggatcttggtcacgcacagcatgagctacttgccgcaggtggacgtcatcatcgtcatgagtggcggcaagatctctgagatgggctcctaccaggagctgctggctcgagacggcgccttcgctgagttcctgcgtacctatgccagcacagagcaggagcaggatgcagaggagaacggggtcacgggcgtcagcggtccagggaaggaagcaaagcaaatggagaatggcatgctggtgacggacagtgcagggaagcaactgcagagacagctcagcagctcctcctcctatagtggggacatcagcaggcaccacaacagcaccgcagaactgcagaaagctgaggccaagaaggaggagacctggaagctgatggaggctgacaaggcgcagacagggcaggtcaagctttccgtgtactgggactacatgaaggccatcggactcttcatctccttcctcagcatcttccttttcatgtgtaaccatgtgtccgcgctggcttccaactattggctcagcctctggactgatgaccccatcgtcaacgggactcaggagcacacgaaagtccggctgagcgtctatggagccctgggcatttcacaagggatcgccgtgtttggctactccatggccgtgtccatcggggggatcttggcttcccgctgtctgcacgtggacctgctgcacagcatcctgcggtcacccatgagcttctttgagcggacccccagtgggaacctggtgaaccgcttctccaaggagctggacacagtggactccatgatcccggaggtcatcaagatgttcatgggctccctgttcaacgtcattggtgcctgcatcgttatcctgctggccacgcccatcgccgccatcatcatcccgccccttggcctcatctacttcttcgtccagaggttctacgtggcttcctcccggcagctgaagcgcctcgagtcggtcagccgctccccggtctattcccatttcaacgagaccttgctgggggtcagcgtcattcgagccttcgaggagcaggagcgcttcatccaccagagtgacctgaaggtggacgagaaccagaaggcctattaccccagcatcgtggccaacaggtggctggccgtgcggctggagtgtgtgggcaactgcatcgttctgtttgctgccctgtttgcggtgatctccaggcacagcctcagtgctggcttggtgggcctctcagtgtcttactcattgcaggtcaccacgtacttgaactggctggttcggatgtcatctgaaatggaaaccaacatcgtggccgtggagaggctcaaggagtattcagagactgagaaggaggcgccctggcaaatccaggagacagctccgcccagcagctggccccaggtgggccgagtggaattccggaactactgcctgcgctaccgagaggacctggacttcgttctcaggcacatcaatgtcacgatcaatgggggagaaaaggtcggcatcgtggggcggacgggagctgggaagtcatccctgaccctgggcttatttcggatcaacgagtctgccgaaggagagatcatcatcgatggcatcaacatcgccaagatcggcctgcacgacctccgcttcaagatcaccatcatcccccaggaccctgttttgttttcgggttccctccgaatgaacctggacccattcagccagtactcggatgaagaagtctggacgtccctggagctggcccacctgaaggacttcgtgtcagcccttcctgacaagctagaccatgaatgtgcagaaggcggggagaacctcagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaagggtgatcgtcttggacaaaggagaaatccaggagtacggcgccccatcggacctcctgcagcagagaggtcttttctacagcatggccaaagacgccggcttggtgtgagccccagagctggcatatctggtcagaactgcagggcctatatgccagcgcccagggaggagtcagtacccctggtaaaccaagcctcccacactgaaaccaaaacataaaaaccaaacccagacaaccaaaacatattcaaagcagcagccaccgccatccggtcccctgcctggaactggctgtgaagacccaggagagacagagatgcgaaccacccaaaacacgcacaccctgcccctggtgccctgagacagacacacagcctcacgcccccaggaatgcaagtggtttcctggtgcttcccacggaggagttttggcagccagacttctggaggaattggttgtatagaagatcctagtgaccaaattcagcctactgcctcggatctctccagccgaagtctgtggactgcaagtctttgagatgcttctggctcccatcacctctaacatccttgtctgggtctaccaggaacgcttcatttccttggggctgcagttttgtggttgaggggcctggagaaaatcattttctccccttggcagtgtcccagggccctggatggtcctcttaccaacatctggtcttccaggcactcaaaagctgggaaccagcatctcagcgccagctctaccagttctcgttttgggccagaggcagcctctgcactcccacgcctgtcctcctggaagggacctggttggactaacggctaacctggacctggaactgtagggccaggggattgtctcagggccgacgttccacctggggcttccctccccacccaccccgactccaggctttcccttttttcttttgttcaacattgtaagaacaatcaatgctgttattactgatcccaccatgattgatgtggggtaaatattaaggagatggcctcatgggaatttgaccttgactagaaatagagactgagagtgagcaaccagctggaaggtactatgccagtcctagcagaaaaatgtgttaggggcctggcccaaagcagtgttggttgcttacagtgttgattgattttgttcttttttcttaccacctcttttctttccctctcatggtacctgctcatggttatgaagctttcaaagtaaagaacacgaaatacctcccaagtattaccagtgggtaccaaaaaaatgtccccttgagtcttttccttgtttttagatgttaattctctcccttggcatccggttagccccccagggggggcagcattgtggagaacttgatatttagttactgatgctcttccaggacacgaaaagaacccatctttgaatatcaatgatttttttttttttaagtactgttccggggagaaaaacagtctcaaaacttgaacttcttgggaagagaagtgttgggctgagaagtaacattcccaggaaatagtgagaagctcgccctgtgtttgaaaccgtgttggtctctgtgttcctggaagaaaacagggaagcagcatcttttaaagcctgttctttaaggtgtctcgttagagcccaaagtggaatccggaaggcagccagagctgaggctgccccaagactcagacttgctaagaattacgccgccgacttcaaacccagagagcatctttcttttaggcgaaaacgcatatatttattttttgtaagttataccattctttcacattagataaactaagttttgggggatccttttgtaatgacttacactggaaatgcgaacatttgcagtaaaaaaatatatatatatctatatatttta

SEQ ID NO: 110155 - DNA, 5088 bp, Homo sapiens
  Payload ID: 1620
  Gene Symbol: ABCC10
  Gene Name: ATP-binding cassette, sub-family C (CFTR/MRP), member 10
  Uniprot ID: Q5T3U5
  ENST ID: ENST00000244533
  CDS Start-End: 360-4754
ttctaatgatcccatcaccaaagtagcaaacgtagtacccaggattttttttttcctagttagtcttcatgttaagtacaatcttacctcaaaattgttaatgtctgtggtttaaaaaaaaacatgaatcagaaatggtgtgggtagtttagaaaatgagttaggttcaggtggccggttagctcagttggtcagaaaatgagttaggttcatctgggaagacttcctgggagaaaagaccctgggttctgaggtaaagtggagtagggataagatgtgcaaggcaggaagggagttgattccttaggtaagtgaattattggaggtgaggggtatgtctggctcctgagtcagccacgatgtgcctccttgtcttcccccttgtccccaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagattgtggtagattaggagcccaaatcaagtggcttctctgttcagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgt

SEQ ID NO: 110156 - DNA, 933 bp, Homo sapiens
  Payload ID: 1620
  Gene Symbol: ABCC10
  Gene Name: ATP-binding cassette, sub-family C (CFTR/MRP), member 10
  ENST ID: ENST00000372515
  CDS Start-End: 103-933
gtgagcgaatactccacgtgagaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggag

SEQ ID NO: 110157 - DNA, 5033 bp, Homo sapiens
  Payload ID: 1620
  Gene Symbol: ABCC10
  Gene Name: ATP-binding cassette, sub-family C (CFTR/MRP), member 10
  Uniprot ID: Q5T3U5
  ENST ID: ENST00000372530
  CDS Start-End: 216-4694
ggcgaatagcgccggctaggtcttccaacctctaggtggggtgccagccggggcgggcccagcaccccggccgggcagtactttttttttttttgcatacaccagttctcaggatatcggaatccggtgcacagcagcttcttcaggtttgaggttccggatgcctgggggcggagaaacgggaggggaaaaacagatggcaaggtgaggcgtccatggaacgacttctggcccagctgtgcggcagcagcgcagcgtggccgctcccgctgtgggagggggacaccacaggccactgcttcacccagctggtgctcagcgccctgccccacgcgctcctcgccgtgctcagtgcctgttacttgggcaccccgaggagtccagattacatcctaccctgcagtcctggatggcgcctccgacttgcagcttccttcctgctttccgtcttcccgctgctagaccttcttccagttgctttgccaccaggggcaggcccaggacccatagggctagaggtgttggcagggtgcgtggcagctgtggcctggatcagccacagcctggccctgtgggtgttggcacattcccctcatggccactcccggggtcccttggccttggccctggtagccttgctgccagctccagccctagtgctgaccgtgttgtggcattgccagcgaggcacacttctgcccccacttctcccagggcccatggcccgcctatgcttgctcatcctgcagctggctgcactcttggcctatgcactgggatgggcagctcctgggggaccacgagaaccctgggctcaggagcccctcctgcccgaggatcaagaacctgaggtggctgaagatggggagagttggctgtcacgcttttcctatgcctggctggcacccttgctggcccgtggggcctgtggagagctccggcagcctcaggacatttgccgcctcccccacagactgcagccaacctacctggctcgtgtcttccaggcacactggcaggagggggcacggctgtggagggccttgtatggggcctttggacggtgctatctggcacttggactgctgaagctggtggggaccatgttgggattctcagggcccctgttgctctccctactggtgggcttcctggaagaggggcaggagccactaagccacggcctgctctatgctctggggctagccggtggggctgtgctgggtgctgtgctgcagaatcagtatgggtatgaggtatataaggtaacacttcaggcacggggggctgtgctgaacatcctgtactgcaaggctttacagctggggcccagccgccctcctactggggaggccctgaacctactaggcactgactctgaacggctgcttaactttgctgggagcttccatgaagcctggggcctgcccctgcaactggccatcaccctctacctgctgtaccagcaggtaggcgtggccttcgtgggtggtctcatcttggcactgctgctggtacccgtcaacaaagtgattgccacccgcatcatggccagcaaccaggaaatgctacagcacaaggatgcgcgggttaagcttgtgacagagctgctgagtggcattcgggtcatcaagttctgcgggtgggagcaggcactgggagcccgagtagaggcctgccgggctcgagagctggggcgactccgggtcatcaaatacctggatgcggcctgtgtatacctgtgggctgccctaccggttgtcatctccatcgttatcttcatcacctatgtcctcatggggcaccagctcactgccaccaaggtgttcacggccctggcactggtgcgaatgctcattcttcctctcaacaacttcccttgggtgatcaatggtctcctggaggccaaagtgtccttggaccggatccagcttttcctcgaccttccaaaccacaacccccaggcctactacagcccagatccccctgcagagccatctacagtattggagctgcatggagccttgttctcctgggacccagttggaaccagcctggagaccttcatcagtcatctcgaagtgaaaaagggtatgctggtgggcatcgtggggaaggtcggctgtgggaagagctccctgctggctgccatcgctggagagctccacaggctgcgtgggcatgtggcagtgcgggggctgtccaagggctttggcctggccacccaggaaccctggatccagtttgccaccatccgagacaacatcctctttgggaagacatttgatgcacagctgtacaaggaggtgctagaagcctgcgccctcaatgatgacctcagtatcctgcctgctggagaccagacagaggtgggggagaagggtgtcacccttagcggaggacagcgtgcccggattgcccttgctcgtgctgtctaccaggaaaaggagctctatctcctcgatgaccctctggccgctgtggatgcagatgtggccaaccacctgctgcacaggtgcatcctgggcatgctgagctacaccacacggctgctctgcacccaccgcactgagtacctggagagggctgacgcggtgctgctgatggaggccgggcgcctcatccgggctggacctccctctgagattctgccactggtacaagctgtccccaaagcctgggctgagaatggacaagagtctgactcagccacagcccagtcagtacagaacccagagaaaacaaaggaggggctggaggaggagcagagcacatctggtcgcctgctgcaggaagaaagcaagaaggagggcgccgtggccttgcacgtgtaccaagcttactggaaggccgtgggccagggcttggccttagccatcctcttctctctgcttctcatgcaagccacgcggaacgctgctgactggtggctctcccactggatctctcagctgaaggctgagaatagctcccaggaggcgcaaccctccaccagcccagcttctatggggctcttctctccgcagctgctcctcttttcccctggaaacctctacatcccagtgttcccactgcccaaagctgcccccaatggctcctcagacatccgtttctacctcaccgtgtatgcgaccattgctggtgtaaattccctctgcacccttctccgggcagtgctctttgcagcaggcacccttcaagcagctgccactctgcatcgccgcctgctgcatcgagtccttatggcaccagtgactttcttcaatgccacacccacgggccggatcctaaaccgcttctcctctgatgtggcctgtgcggatgacagcctgcccttcatcctcaacatcctcctggccaacgcggcaggcctgctggggctcctggccgtgctgggctctggcctgccctggctgctgctcctgctgccgcctttgagcatcatgtactatcacgtgcagcgccactacagggcctcctcacgggagctgcggcgcctgggcagcctcaccctgtctccactgtatagccatctggccgataccttggctggcctctctgtgctccgggccacaggggccacctacaggtttgaggaggagaacctgcgactccttgagctaaaccagaggtgccagtttgccaccagtgccacaatgcagtggctggacattcggctacagctcatgggggcggcagtggtcagcgctatcgcaggcatcgctctggtgcagcaccagcagggcctcgctaacccagggctggtgggcttgtcgctgtcttatgccctgtccctgacgggcctgctctcgggcctggtgagcagcttcacacagacagaggccatgctggtgagcgtcgagcggctggaagagtacacctgtgacctgccccaggaaccccagggccagccactgcagctgggcaccggctggctgacccaggggggcgtggagttccaggacgtggtgttggcgtaccggccagggctgccgaatgccctggatggagtgaccttctgcgtgcagcctggagagaagttgggcatcgtgggccgcacaggctccggcaagtcttccctgttgttggtgctcttccggctgctagagcccagttcagggcgagtgctgctggacggcgtggacaccagccagctggagctggcccagctcagatcccagttggctatcatcccccaggagccctttttgttcagtgggactgttcgggaaaacctggacccccagggcctacataaggacagggccttgtggcaggccctgaagcagtgccacctgagtgaggtgattacatccatgggtggtctggatggtgagctgggtgaggggggccggagcttatctcttgggcagaggcagctgttgtgtttggccagggctctcctcacagatgccaagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctggtgtgaggc

SEQ ID NO: 110158 - DNA, 721 bp, Homo sapiens
  Payload ID: 1620
  Gene Symbol: ABCC10
  Gene Name: ATP-binding cassette, sub-family C (CFTR/MRP), member 10
  ENST ID: ENST00000505344
  CDS Start-End: 1-390
gaggagggcatagccaggaaggctttatataaactcacagcagccagggctgatcagggggctgaaatggaggacaggatgagcaggcaaggacagcgaactcctagtgcccagatcctgtgtatcgatgaggccacagcaagtgtggaccagaagacagaccagctgctccagcagaccatctgcaaacgctttgccaacaagacagtgctgaccattgcccataggctcaacacgatcctgaactcagaccgggtgctggtgctacaagcggggagagtggtagagctggactccccggccaccctgcgcaaccagccccactccctgttccagcagctgctgcagagcagccagcagggagtccctgcctcactcggaggtccctgagcccaatcccacaccctgcagagttctcccctctctctgatccaggccgggcctatacagaggtgctggctgcttgtttacattctcctctggggctctacctctccacacttccccagaagggaaaagggcaccctggattactctttggaaatcactccttggtgggcagcatcctgaggcttccccagaaccaggcctctgctctggccctcttgcatctggaacgccaggtgggtttttctggcataggagcccacttgcattttcatagttttatttgataaaattccatcttacattctgtgtattaaaaaaataatatttctgg

SEQ ID NO: 110159 - DNA, 4463 bp, Homo sapiens
  Payload ID: 1621
  Gene Symbol: ABCC11
  Gene Name: ATP-binding cassette, sub-family C (CFTR/MRP), member 11
  Uniprot ID: Q96J66
  ENST ID: ENST00000353782
  CDS Start-End: 65-4099
gtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 110160 - DNA, 4612 bp, Homo sapiens
  Payload ID: 1621
  Gene Symbol: ABCC11
  Gene Name: ATP-binding cassette, sub-family C (CFTR/MRP), member 11
  Uniprot ID: Q96J66
  ENST ID: ENST00000356608
  CDS Start-End: 100-4248
gtcacctggatagcgcaaaggaaacaagagaaaggaacagagcccctcttctggcctctgggctaccatacagaaaagcagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactca

SEQ ID NO: 110161 - DNA, 4862 bp, Homo sapiens
  Payload ID: 1621
  Gene Symbol: ABCC11
  Gene Name: ATP-binding cassette, sub-family C (CFTR/MRP), member 11
  Uniprot ID: Q96J66
  ENST ID: ENST00000394747
  CDS Start-End: 351-4499
actgggataaagcaagaagactgattttatgagcaggggtttgatacatcaaaggagattgcccaggatcaagggtgcggtgttgggggtgggttggggagggtggttagagaaggtttcactaagtgatttgggcctgaggcctgagaagatgtttaaaaagagggatcaagcacaggctaaggagaggaaagagcaggcacccaaacctctgcatggccccaatatgctccctgcagggtagtgccccctcttctggctgctcaaggcgagatctaagcttcttctaactcctgctgtcttttcatattctctgattctgggaaacgaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 110162 - DNA, 4576 bp, Homo sapiens
  Payload ID: 1621
  Gene Symbol: ABCC11
  Gene Name: ATP-binding cassette, sub-family C (CFTR/MRP), member 11
  Uniprot ID: Q96J66
  ENST ID: ENST00000394748
  CDS Start-End: 65-4213
gtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccagagaacaaggttgattttcgatgcacttctgggcatctgcttctgcattgccagtgtactcgggccaatattgattataccaaagatcctggaatattcagaagagcagttggggaatgttgtccatggagtgggactctgctttgccctttttctctccgaatgtgtgaagtctctgagtttctcctccagttggatcatcaaccaacgcacagccatcaggttccgagcagctgtttcctcctttgcctttgagaagctcatccaatttaagtctgtaatacacatcacctcaggagaggccatcagcttcttcaccggtgatgtaaactacctgtttgaaggggtgtgctatggacccctagtactgatcacctgcgcatcgctggtcatctgcagcatttcttcctacttcattattggatacactgcatttattgccatcttatgctatctcctggttttcccactggcggtattcatgacaagaatggctgtgaaggctcagcatcacacatctgaggtcagcgaccagcgcatccgtgtgaccagtgaagttctcacttgcattaagctgattaaaatgtacacatgggagaaaccatttgcaaaaatcattgaagacctaagaaggaaggaaaggaaactattggagaagtgcgggcttgtccagagcctgacaagtataaccttgttcatcatccccacagtggccacagcggtctgggttctcatccacacatccttaaagctgaaactcacagcgtcaatggccttcagcatgctggcctccttgaatctccttcggctgtcagtgttctttgtgcctattgcagtcaaaggtctcacgaattccaagtctgcagtgatgaggttcaagaagtttttcctccaggagagccctgttttctatgtccagacattacaagaccccagcaaagctctggtctttgaggaggccaccttgtcatggcaacagacctgtcccgggatcgtcaatggggcactggagctggagaggaacgggcatgcttctgaggggatgaccaggcctagagatgccctcgggccagaggaagaagggaacagcctgggcccagagttgcacaagatcaacctggtggtgtccaaggggatgatgttaggggtctgcggcaacacggggagtggtaagagcagcctgttgtcagccatcctggaggagatgcacttgctcgagggctcggtgggggtgcagggaagcctggcctatgtcccccagcaggcctggatcgtcagcgggaacatcagggagaacatcctcatgggaggcgcatatgacaaggcccgatacctccaggtgctccactgctgctccctgaatcgggacctggaacttctgccctttggagacatgacagagattggagagcggggcctcaacctctctggggggcagaaacagaggatcagcctggcccgcgccgtctattccgaccgtcagatctacctgctggacgaccccctgtctgctgtggacgcccacgtggggaagcacatttttgaggagtgcattaagaagacactcagggggaagacggtcgtcctggtgacccaccagctgcagtacttagaattttgtggccagatcattttgttggaaaatgggaaaatctgtgaaaatggaactcacagtgagttaatgcagaaaaaggggaaatatgcccaacttatccagaagatgcacaaggaagccacttcggacatgttgcaggacacagcaaagatagcagagaagccaaaggtagaaagtcaggctctggccacctccctggaagagtctctcaacggaaatgctgtgccggagcatcagctcacacaggaggaggagatggaagaaggctccttgagttggagggtctaccaccactacatccaggcagctggaggttacatggtctcttgcataattttcttcttcgtggtgctgatcgtcttcttaacgatcttcagcttctggtggctgagctactggttggagcagggctcggggaccaatagcagccgagagagcaatggaaccatggcagacctgggcaacattgcagacaatcctcaactgtccttctaccagctggtgtacgggctcaacgccctgctcctcatctgtgtgggggtctgctcctcagggattttcaccaaggtcacgaggaaggcatccacggccctgcacaacaagctcttcaacaaggttttccgctgccccatgagtttctttgacaccatcccaataggccggcttttgaactgcttcgcaggggacttggaacagctggaccagctcttgcccatcttttcagagcagttcctggtcctgtccttaatggtgatcgccgtcctgttgattgtcagtgtgctgtctccatatatcctgttaatgggagccataatcatggttatttgcttcatttattatatgatgttcaagaaggccatcggtgtgttcaagagactggagaactatagccggtctcctttattctcccacatcctcaattctctgcaaggcctgagctccatccatgtctatggaaaaactgaagacttcatcagccagtttaagaggctgactgatgcgcagaataactacctgctgttgtttctatcttccacacgatggatggcattgaggctggagatcatgaccaaccttgtgaccttggctgttgccctgttcgtggcttttggcatttcctccaccccctactcctttaaagtcatggctgtcaacatcgtgctgcagctggcgtccagcttccaggccactgcccggattggcttggagacagaggcacagttcacggctgtagagaggatactgcagtacatgaagatgtgtgtctcggaagctcctttacacatggaaggcacaagttgtccccaggggtggccacagcatggggaaatcatatttcaggattatcacatgaaatacagagacaacacacccaccgtgcttcacggcatcaacctgaccatccgcggccacgaagtggtgggcatcgtgggaaggacgggctctgggaagtcctccttgggcatggctctcttccgcctggtggagcccatggcaggccggattctcattgacggcgtggacatttgcagcatcggcctggaggacttgcggtccaagctctcagtgatccctcaagatccagtgctgctctcaggaaccatcagattcaacctagatccctttgaccgtcacactgaccagcagatctgggatgccttggagaggacattcctgaccaaggccatctcaaagttccccaaaaagctgcatacagatgtggtggaaaacggtggaaacttctctgtgggggagaggcagctgctctgcattgccagggctgtgcttcgcaactccaagatcatccttatcgatgaagccacagcctccattgacatggagacagacaccctgatccagcgcacaatccgtgaagccttccagggctgcaccgtgctcgtcattgcccaccgtgtcaccactgtgctgaactgtgaccacatcctggttatgggcaatgggaaggtggtagaatttgatcggccggaggtactgcggaagaagcctgggtcattgttcgcagccctcatggccacagccacttcttcactgagataaggagatgtggagacttcatggaggctggcagctgagctcagaggttcacacaggtgcagcttcgaggcccacagtctgcgaccttcttgtttggagatgagaacttctcctggaagcaggggtaaatgtagggggggtggggattgctggatggaaaccctggaataggctacttgatggctctcaagaccttagaaccccagaaccatctaagacatgggattcagtgatcatgtggttctccttttaacttacatgctgaataattttataataaggtaaaagcttatagttttctgatctgtgttagaagtgttgcaaatgctgtactgactttgtaaaatataaaactaaggaaaactc

SEQ ID NO: 110163 - DNA, 582 bp, Homo sapiens
  Payload ID: 1621
  Gene Symbol: ABCC11
  Gene Name: ATP-binding cassette, sub-family C (CFTR/MRP), member 11
  ENST ID: ENST00000569991
  CDS Start-End: 106-582
ttaaaaaggctcctgcaggcaacatgcctgcacactaacgtgcagaaagggactgtactactcaaaaccaccaaggaagtggcagagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagtatgatgctgccttgagaaccatgattcccttccgtcccaagccgaggtttcctgccccccagcccctggacaatgctggcctgttctcctacctcaccgtgtcatggctcaccccgctcatgatccaaagcttacggagtcgcttagatgagaacaccatccctccactgtcagtccatgatgcctcagacaaaaatgtccaaaggcttcaccgcctttgggaagaagaagtctcaaggcgagggattgaaaaagcttcagtgcttctggtgatgctgaggttccag

SEQ ID NO: 110164 - DNA, 5168 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000311303
  CDS Start-End: 347-4426
gccttggtcattggaccggctcccaaccaaaaccacaccatagggttttctgctcttggccaacccaacatgagaaaagaggaattaaatggtcctactaataagaaagcctcagcgtagcattaagggacgtagcaggtcttctggccacactcccctacaaatgtggaaagctcattggtgaaaacagttctcaggggtcaaagcaaaggaactgatctgggtaaagtagaggctgcctgatcccaatcagacatcctcacctctcaataacctttgccatttctctgccatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccggtgattctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctatcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaaggtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatgccttaggatggagtttgcaaggtttccttgcccattatcagaaggaaaaagagcagaattttcttctcgtttaaccccactcacttccatcttgactgggtgacaagtggtaatgacacagatttgtagcgtgaaagactgaatacagtgtttggccaaaaatttttttaaaaatcatattatatgtttcaattgatctgttagaataaccaagaaaacaaaatgctggagtttctctataaatgacacttttatatcttctttattcgtcgttaaaacgcggtaggaaattaccctgaaatgtcgccttgcaattatttcactgaagatattccaatttccatactatttcctccaatagacccttgttgcct

SEQ ID NO: 110165 - DNA, 4047 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000497206
  CDS Start-End: 7-3036
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaagataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 110166 - DNA, 4379 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000534418
  CDS Start-End: 227-3019
cattaagggacgtagcaggtcttctggccacactcccctacaaatgtggaaagctcattggtgaaaacagttctcaggggtcaaagcaaaggaactgatctgggtaaagtagaggctgcctgatcccaatcagacatcctcacctctcaataacctttgccatttctctgccatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctggtataatcgttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaagataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatg

SEQ ID NO: 110167 - DNA, 3885 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000529504
  CDS Start-End: 7-2814
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtacaacttggatccctttgagagtcacaccgatgagatgctctggcaggttctggagagaacattcatgagagacacaataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 110168 - DNA, 4814 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000529084
  CDS Start-End: 498-2399
ggtgggagtggcagttgaatggggcagttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccagggctgccaaatttagcaaagtgccattccagctgcaatgcttccaagccgcctcagatcatcaaaacttcacatgccctggggagcactcaaggaaattaccttctagcaccaatttcctatgcgcgctgattactcaaacctggccagggaggcctggcctccagtgtttggcatctgggactcaggagcccttaagacaagctgatgacatcttgctgccagggtcccttaccattagaaaagggaaccaaaaaatagaagttatagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttgtaggtacagtaagataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattctagaggaggaagaggctctgtgagatgaataggaggagtcttcaggaggaggggctgtcctctccgcaggcagccctggtcttcagcccctcccatccacggagtgagctggggctgaagttgtccccactgccatactcagtccatgtcaccccacttggtgggcttggggttggttctgggtggtgaaccggggcagacccagctaatggattaaaaaactgcccttcacctcccaaatccccaagggttcctcatgtgttttcaccaaaaccaccccagtgcctgagattgaaaatattgtaactttcagttagaaatcagccacaataaacaacatgggaaaatg

SEQ ID NO: 110169 - DNA, 1224 bp, Homo sapiens
  Payload ID: 1622
  Gene Symbol: ABCC12
  Gene Name: ATP-binding cassette, sub-family C (CFTR/MRP), member 12
  ENST ID: ENST00000533639
  CDS Start-End: 204-1061
agttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccct

SEQ ID NO: 110170 - DNA, 544 bp, Homo sapiens
  Payload ID: 1622
  Gene Symbol: ABCC12
  Gene Name: ATP-binding cassette, sub-family C (CFTR/MRP), member 12
  ENST ID: ENST00000527640
  CDS Start-End: 227-544
agttggagaggaggacttcaggcgggtgggacaagagaaactgaatctgaggtccttggggagaagcaggccctggagtcctgggcagcagatgccaggctctgagccccatgactgctgaccctcctcccctccctctcatcctcagcccaggtaaagcttcatttccagcccagagtgaaagtgtccccaggccaaaagcccagggctccaggctgccatcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcct

SEQ ID NO: 110171 - DNA, 4033 bp, Homo sapiens
  Payload ID: 1622
  Gene Symbol: ABCC12
  Gene Name: ATP-binding cassette, sub-family C (CFTR/MRP), member 12
  Uniprot ID: Q96J65
  ENST ID: ENST00000532494
  CDS Start-End: 7-3036
atcaggatggtgggtgaaggaccctaccttatctcagatctggaccagcgaggccggcggagatcctttgcagaaagatatgaccccagcctgaagaccatgatcccagtgcgaccctgtgcaaggttagcacccaacccggtggatgatgccgggctactctccttcgccacattttcctggctcacgccggtgatggtgaaaggctaccggcaaaggctgaccgtagacaccctgcccccattgtcgacatatgactcatctgacaccaatgccaaaagatttcgagtcctttgggatgaagaggtagcaagggtgggtcctgagaaggcctctctgagccacgtggtgtggaaattccagaggacacgcgtgttgatggacatcgtggccaacatcctgtgcatcatcatggcagccatagggccgacagttctcattcaccaaatcctccagcagactgagaggacctctgggaaagtctgggttggcattggactgtgcatagccctttttgccaccgagtttaccaaagtcttcttttgggcccttgcctgggccatcaactaccgcacggccatccggttgaaggtggcgctctccaccttggtttttgaaaacctagtgtccttcaagacattgacccacatctctgttggcgaggtgctcaatatactgtcaagtgatagctattctttgtttgaagctgccttgttttgtcctttgccagccaccatcccgatcctaatggtcttttgtgcggcgtacgcctttttcattctggggcccacagctctcatcgggatatcagtgtatgtcatattcatacccgtccagatgtttatggccaagctcaattcagctttccgaaggtcagcaattttggtgacagacaagcgagttcagacaatgaatgagtttctgacctgcatcaggctgatcaaaatgtatgcctgggagaaatcttttaccaacactatccaagatataagaaggagggaaagaaaattactggaaaaagctggatttgtccaaagtggaaactctgccctggcccccatcgtgtccaccatagccatcgtgctgacattatcctgccacatcctcctgagacgcaaactcaccgcacccgtggcatttagtgtgattgccatgtttaatgtaatgaagttttccattgcaatcttgcccttctccatcaaagcaatggctgaagcgaatgtctctctaaggagaatgaagaaaattctcatagataaaagccccccatcttacatcacccaaccagaagacccagatactgtcttgcttttagcaaatgccaccttgacatgggagcatgaagccagcaggaaaagtaccccaaagaaattgcagaaccagaaaaggcatttatgcaagaaacagaggtcagaggcatacagtgagaggagtccaccagccaagggagccactggcccagaggagcaaagtgacagcctcaaatcggttctgcacagcataagctttgtggtgagaaaggggaagatcttgggaatatgtgggaatgtgggaagtggaaagagctccctccttgcagctctcctaggacagatgcagctgcagaaaggggtggtggcagtcaatggaactttggcctacgtttcacagcaggcatggatctttcatggaaatgtgagagaaaacatactctttggagaaaagtatgatcaccaaaggtatcagcacacagtccgcgtctgtggcctccagaaggacctgagcaacctcccctatggagacctgactgagattggggagcggggcctcaacctctctggggggcagaggcagaggattagcctggcccgcgctgtctactccgaccgtcagctctacctgctggacgaccccctgtcggccgtggacgcccacgtggggaagcacgtctttgaggagtgcattaagaagacgctcaggggaaagacagtcgtcctggtgacccaccagctacagttcttagagtcttgtgatgaagttattttattagaagatggagagatttgtgaaaagggaacccacaaggagttaatggaggagagagggcgctatgcaaaactgattcacaacctgcgaggattgcagttcaaggatcctgaacacctttacaatgcagcaatggtggaagccttcaaggagagccctgctgagagagaggaagatgctgttttggctccaggaaatgagaaagatgaaggaaaagaatctgaaacaggctcagaatttgtagacacaaaagttcctgagcaccagctcatccagactgaatccccccaggaaggaaccgtgacctggaaaacatatcacacgtacattaaggcttctggagggtacctcctttctctcttcactgtgttcctcttcctcctgatgattggcagcgctgccttcagcaactggtggctgggtctctggttggacaagggctcacggatgacctgtgggccccagggcaacaggaccatgtgtgaggtcggcgcggtgctggcagacatcggtcagcatgtgtaccagtgggtgtacactgcaagcatggtgttcatgctggtgtttggcgtcaccaaaggcttcgtcttcaccaagaccacactgatggcatcctcctctctgcatgacacggtgtttgataagatcttaaagagcccaatgagtttctttgacacgactcccactggcaggctaatgaaccgtttttccaaggatatggacgagctggatgtgaggctgccgtttcacgcagagaactttctgcagcagttttttatggtggtgtttattctcgtgatcttggctgctgtgtttcctgctgtccttttagtcgtggccagccttgctgtaggcttcttcattctgttacgcattttccacagaggagtccaggagctcaagaaggtggagaatgtcagccggtcaccctggttcacccacatcacctcctccatgcagggcctgggcatcattcacgcctatggcaagaaggagagctgcatcacctagtttaagacgctaaacgacgaaaactccagtcacctcctctactttaactgtgctctcaggtggtttgcgctgagaatggatgtcctcatgaacatccttaccttcactgtggccttgttggtgaccctgagtttctcctccatcagtacttcatccaaaggcctgtcattgtcatacatcatccagctgagcggactgctccaagtgtgtgtgcgaacgggaacagagacgcaagccaaattcacctccgtggagctgctcagggaatacatttcgacctgtgttcctgaatgcactcatcccctcaaagtggggacctgtcccaaggactggcccagccgtggggagatcaccttcagagactatcagatgagatacagagacaacaccccccttgttctcgacagcctgaacttgaacatacaaagtgggcagacagtcgggattgttggaagaacaggttccggaaagtcatcgttaggaatggctttgtttcgtctggtggagccagccagtggcacaatctttattgatgaggtggatatctgcattctcagcttggaagacctcagaaccaagctgactgtgatcccacaggatcctgtcctgtttataatgaaactcccagaaaaattacaggcagaagtcacagaaaatggagaaaacttctcagtaggggaacgtcagctgctttgtgtggcccgagctcttctccgtaattcaaagatcattctccttgatgaagccaccgcctctatggactccaagactgacaccctggttcagaacaccatcaaagatgccttcaagggctgcactgtgctgaccatcgcccaccgcctcaacacagttctcaactgcgatcacgtcctggttatggaaaatgggaaggtgattgagtttgacaagcctgaagtccttgcagagaagccagattctgcatttgcgatgttactagcagcagaagtcagattgtagaggtcctggcggctgattc

SEQ ID NO: 110172 - DNA, 1714 bp, Homo sapiens
  Payload ID: 1623
  Gene Symbol: ABCC2
  Gene Name: ATP-binding cassette, sub-family C (CFTR/MRP), member 2
  ENST ID: ENST00000370434
  CDS Start-End: 83-964
tttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggctacctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggtaactttcccttgagtgtctgtgtgagcgcgctgcatgtttcaggcaagggtacatcagcatcatggcgattctgtccttacatttttatagcacttcatacttctcagtgcacttcatattattaatggtattcacaatactgatactaccttagtgatggatacatggcgtgtaatgtactgttctctttcctttggggtacttttgaaattttccagaatgaaacgtggttttgaaaaaaataataccttagcatttctagattttgcaccttggtacaaattagcataagcaggcaatttgttgattcattcacttgaaaatatttattgagcacaactgtgtgtcagtgaccattctgggcactaaaagattgctcatcttttgtgagctagaaaatatgtagtaagcccatacataggttactctttgaaagtaataatagctattaagaaaataaaacaatagtgtatttggagtgaagtgcgacttgagacagggtaacaggggaagcttctcagaggagatgacatctgaacagacactcaaatgatgagatcaggccctctgagggacagtcagagggaagtgtgttccagtcagaaggagcaggcatgcgaggctgagaggggaacacatttggcttgctcagggaatggcaagaagatccaggacagggtgcgcatggggtgagatgggctcaaggaagtggacagggattaagctatgtggacccctgtgggccacaataaggaatctgga

SEQ ID NO: 110173 - DNA, 5312 bp, Homo sapiens
  Payload ID: 1623
  Gene Symbol: ABCC2
  Gene Name: ATP-binding cassette, sub-family C (CFTR/MRP), member 2
  Uniprot ID: Q92887
  ENST ID: ENST00000370449
  CDS Start-End: 114-4751
acatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggctacctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattgtctacctcgatcgtacttccttgctacccacccctcccagggacaaccactgtcctgaatttcacgataattattcctttgcctttcatttctgttttatcacctttgtatgtatctttaaacaacatatacccttttttacttatgtaaatggactgactcatactgcatacatcttctatgacttgattcttttgttcaatattatatctgagattcatccatggtgatgcaaataggtgcattattttttttcactgctctgtagtctggcattgtatgaatacagcacaatgtatcagttttaatattggggatcattagcattattctcaggtttttaaaaattataagcagtactactatgg

SEQ ID NO: 110174 - DNA, 5716 bp, Homo sapiens
  Payload ID: 1624
  Gene Symbol: ABCC3
  Gene Name: ATP-binding cassette, sub-family C (CFTR/MRP), member 3
  Uniprot ID: O15438
  ENST ID: ENST00000285238
  CDS Start-End: 81-4664
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagtatatacacagtagtctttttgcacttgttcacaaggtttggggattaggatctttggaggaggccaagaggaagactttctacacatgtacatggttgtagttacctgaacttcagacccaagagctcttggctgcaaatattgccttcacagccaaaattccctgggtaattgccagtagctcctgctctgctgtgcagatattgtaaaacggtgagaaaggccctgaaatctgacctggggcctcttgggaaagctgctgtgaacacctccacgttaatgtcatccctcagccctctatgcctgtttctctagggactgagaagtgcatgatgcttttacttccttgctcatttcgaagtctgttccagacagttcctataaccagtgaggcctccaagtcattcattttcctcagtctagccaaagctgaatgtgtgagcacaaagaagccgagaggccacctcctgcccagagagaagccacccacactcccaggttggcagacaagatgtgaggggtgaattaaatttgttttcttgagcaagcca

SEQ ID NO: 110175 - DNA, 1881 bp, Homo sapiens
  Payload ID: 1624
  Gene Symbol: ABCC3
  Gene Name: ATP-binding cassette, sub-family C (CFTR/MRP), member 3
  Uniprot ID: O15438
  ENST ID: ENST00000427699
  CDS Start-End: 81-1799
gcggaggcggctccggcgcccgctctgcccgccgctgggtccgaccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaggcttggcacagggctgggtccctgcctccagggctctgggtgcccaggcatggccagggctcattggactctaccctgacaccacctccacgctgctcaggtgaccctgatcaccctctgggtgtacgtgtacgtggacccaaacaatgtgctggacgccg

SEQ ID NO: 110176 - DNA, 898 bp, Homo sapiens
  Payload ID: 1624
  Gene Symbol: ABCC3
  Gene Name: ATP-binding cassette, sub-family C (CFTR/MRP), member 3
  ENST ID: ENST00000513745
  CDS Start-End: 1-898
tgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtggctgagc

SEQ ID NO: 110177 - DNA, 856 bp, Homo sapiens
  Payload ID: 1624
  Gene Symbol: ABCC3
  Gene Name: ATP-binding cassette, sub-family C (CFTR/MRP), member 3
  ENST ID: ENST00000510633
  CDS Start-End: 1-171
gcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaaggtgaggcctgccagaggctaagggggctaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaag

SEQ ID NO: 110178 - DNA, 656 bp, Homo sapiens
  Payload ID: 1624
  Gene Symbol: ABCC3
  Gene Name: ATP-binding cassette, sub-family C (CFTR/MRP), member 3
  ENST ID: ENST00000515707
  CDS Start-End: 50-280
cgggggcagggagaccggacccagaggcactgggccgcgcctcggccccatggacgccctgtgcggttccggggagctcggctccaagttctggcactggggagcccgggaaagtgaggaagagtgcgcggctggggcgcaaaggcacagtgcgtggctgggtgagtcggctccatcccagcccctccgtcgggtgcggaaggggcgtttcgcaatcagccgcgggttcctgatggagggtcttccctcagcatctgcctcaggtaagactgaggtctgagagcaggccatccccaccactccggactcagaagggagaagcagaccccagtctggagacaggtgcagggtgtcaggattcctgtagtccaactcccttctcacagatggagaaagggaggcccagagagaggaagggacttgcccaaagttacccagttcaatgaaggcagagctgggatagaaaaacaggctacaggccaggtgcagtggttcacgcctgtaatcccaccctttgggaggcagaggtgggaggatcacttcagcccaggagttttagattactgtgagctatgatcgcaccactgcactgtggcctgggcgaaagagtgagaccctgtctctaaaaaaataaataaataagaaaagaaaatcaa

SEQ ID NO: 110179 - DNA, 484 bp, Homo sapiens
  Payload ID: 1624
  Gene Symbol: ABCC3
  Gene Name: ATP-binding cassette, sub-family C (CFTR/MRP), member 3
  ENST ID: ENST00000515585
  CDS Start-End: 1-131
ctgccctcatcttggcctgcttcagggagaaacctccatttttctccgcaaagaatgtcgaccctaacccctaccctgagaccagcgctggctttctctcccgcctgtttttctggtggttcacaaagtgagttggctcttccaccagccaggccagagggaggggagggatggaaggatggccatctatggctaccggcatcccctggaggagaaggacctctggtccctaaaggaagaggacagatcccagatggtggtgcagcagctgctggaggcatggaggaagcaggaaaagcagacggcacgcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacagg

SEQ ID NO: 110180 - DNA, 1042 bp, Homo sapiens
  Payload ID: 1624
  Gene Symbol: ABCC3
  Gene Name: ATP-binding cassette, sub-family C (CFTR/MRP), member 3
  ENST ID: ENST00000513511
  CDS Start-End: 124-255
gggctcggcagggcgggtccgggcggagcgcggggtgcggagggcggaggcggctccggcgcccgctctgcccgccgctgggtccgaccgcgctcgccttccttgcagccgcgcctcggccccatggacgccctgtgcggttccggggagctcggctccaagttctggaacccagcccactgcctgactcaccaaggccctcaccaaacattgtcaaggccaagagtgacgctccagggaaggggatctctctaggaggaagggtgctcaagatgaagaaggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacg

SEQ ID NO: 110181 - DNA, 5326 bp, Homo sapiens
  Payload ID: 1624
  Gene Symbol: ABCC3
  Gene Name: ATP-binding cassette, sub-family C (CFTR/MRP), member 3
  Uniprot ID: O15438
  ENST ID: ENST00000502426
  CDS Start-End: 37-1569
ccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagctgctaaaccctgaccctctgcggggctgcctgccgggcttcacctccccccaggatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagta

SEQ ID NO: 110182 - DNA, 5271 bp, Homo sapiens
  Payload ID: 1624
  Gene Symbol: ABCC3
  Gene Name: ATP-binding cassette, sub-family C (CFTR/MRP), member 3
  Uniprot ID: O15438
  ENST ID: ENST00000505699
  CDS Start-End: 37-3753
ccgcgctcgccttccttgcagccgcgcctcggccccatggacgccctgtgcggttccggggagctcggctccaagttctgggactccaacctgtctgtgcacacagaaaacccggacctcactccctgcttccagaactccctgctggcctgggtgccctgcatctacctgtgggtcgccctgccctgctacttgctctacctgcggcaccattgtcgtggctacatcatcctctcccacctgtccaagctcaagatggtcctgggtgtcctgctgtggtgcgtctcctgggcggaccttttttactccttccatggcctggtccatggccgggcccctgcccctgttttctttgtcacccccttggtggtgggggtcaccatgctgctggccaccctgctgatacagtatgagcggctgcagggcgtacagtcttcgggggtcctcattatcttctggttcctgtgtgtggtctgcgccatcgtcccattccgctccaagatccttttagccaaggcagagggtgagatctcagaccccttccgcttcaccaccttctacatccactttgccctggtactctctgccctcatcttggcctgcttcagggagaaacctccatttttctccgcaaagaatgtcgaccctaacccctaccctgagaccagcgctggctttctctcccgcctgtttttctggtggttcacaaagatggccatctatggctaccggcatcccctggaggagaaggacctctggtccctaaaggaagaggacagatcccagatggtggtgcagcagctgctggaggcatggaggaagcaggaaaagcagacggcacgacacaaggcttcagcagcacctgggaaaaatgcctccggcgaggacgaggtgctgctgggtgcccggcccaggccccggaagccctccttcctgaaggccctgctggccaccttcggctccagcttcctcatcagtgcctgcttcaagcttatccaggacctgctctccttcatcaatccacagctgctcagcatcctgatcaggtttatctccaaccccatggccccctcctggtggggcttcctggtggctgggctgatgttcctgtgctccatgatgcagtcgctgatcttacaacactattaccactacatctttgtgactggggtgaagtttcgtactgggatcatgggtgtcatctacaggaaggctctggttatcaccaactcagtcaaacgtgcgtccactgtgggggaaattgtcaacctcatgtcagtggatgcccagcgcttcatggaccttgcccccttcctcaatctgctgtggtcagcacccctgcagatcatcctggcgatctacttcctctggcagaacctaggtccctctgtcctggctggagtcgctttcatggtcttgctgattccactcaacggagctgtggccgtgaagatgcgcgccttccaggtaaagcaaatgaaattgaaggactcgcgcatcaagctgatgagtgagatcctgaacggcatcaaggtgctgaagctgtacgcctgggagcccagcttcctgaagcaggtggagggcatcaggcagggtgagctccagctgctgcgcacggcggcctacctccacaccacaaccaccttcacctggatgtgcagccccttcctggtgaccctgatcaccctctgggtgtacgtgtacgtggacccaaacaatgtgctggacgccgagaaggcctttgtgtctgtgtccttgtttaatatcttaagacttcccctcaacatgctgccccagttaatcagcaacctgactcaggccagtgtgtctctgaaacggatccagcaattcctgagccaagaggaacttgacccccagagtgtggaaagaaagaccatctccccaggctatgccatcaccatacacagtggcaccttcacctgggcccaggacctgccccccactctgcacagcctagacatccaggtcccgaaaggggcactggtggccgtggtggggcctgtgggctgtgggaagtcctccctggtgtctgccctgctgggagagatggagaagctagaaggcaaagtgcacatgaagggctccgtggcctatgtgccccagcaggcatggatccagaactgcactcttcaggaaaacgtgcttttcggcaaagccctgaaccccaagcgctaccagcagactctggaggcctgtgccttgctagctgacctggagatgctgcctggtggggatcagacagagattggagagaagggcattaacctgtctgggggccagcggcagcgggtcagtctggctcgagctgtttacagtgatgccgatattttcttgctggatgacccactgtccgcggtggactctcatgtggccaagcacatctttgaccacgtcatcgggccagaaggcgtgctggcaggcaagacgcgagtgctggtgacgcacggcattagcttcctgccccagacagacttcatcattgtgctagctgatggacaggtgtctgagatgggcccgtacccagccctgctgcagcgcaacggctcctttgccaactttctctgcaactatgcccccgatgaggaccaagggcacctggaggacagctggaccgcgttggaaggtgcagaggataaggaggcactgctgattgaagacacactcagcaaccacacggatctgacagacaatgatccagtcacctatgtggtccagaagcagtttatgagacagctgagtgccctgtcctcagatggggagggacagggtcggcctgtaccccggaggcacctgggtccatcagagaaggtgcaggtgacagaggcgaaggcagatggggcactgacccaggaggagaaagcagccattggcactgtggagctcagtgtgttctgggattatgccaaggccgtggggctctgtaccacgctggccatctgtctcctgtatgtgggtcaaagtgcggctgccattggagccaatgtgtggctcagtgcctggacaaatgatgccatggcagacagtagacagaacaacacttccctgaggctgggcgtctatgctgctttaggaattctgcaagggttcttggtgatgctggcagccatggccatggcagcgggtggcatccaggctgcccgtgtgttgcaccaggcactgctgcacaacaagatacgctcgccacagtccttctttgacaccacaccatcaggccgcatcctgaactgcttctccaaggacatctatgtcgttgatgaggttctggcccctgtcatcctcatgctgctcaattccttcttcaacgccatctccactcttgtggtcatcatggccagcacgccgctcttcactgtggtcatcctgcccctggctgtgctctacaccttagtgcagcgcttctatgcagccacatcacggcaactgaagcggctggaatcagtcagccgctcacctatctactcccacttttcggagacagtgactggtgccagtgtcatccgggcctacaaccgcagccgggattttgagatcatcagtgatactaaggtggatgccaaccagagaagctgctacccctacatcatctccaaccggtcagaagccgcctccctcgctccctgctcctccaggaattcccagcaggctctctggtgttcagggtccttgtccctcctttcccctaagcagaaaactggccctgccctgcccctgccccatttcctcctcatctgatcccccataggtggctgagcatcggagtggagttcgtggggaactgcgtggtgctctttgctgcactatttgccgtcatcgggaggagcagcctgaacccggggctggtgggcctttctgtgtcctactccttgcaggtgacatttgctctgaactggatgatacgaatgatgtcagatttggaatctaacatcgtggctgtggagagggtcaaggagtactccaagacagagacagaggcgccctgggtggtggaaggcagccgccctcccgaaggttggcccccacgtggggaggtggagttccggaattattctgtgcgctaccggccgggcctagacctggtgctgagagacctgagtctgcatgtgcacggtggcgagaaggtggggatcgtgggccgcactggggctggcaagtcttccatgaccctttgcctgttccgcatcctggaggcggcaaagggtgaaatccgcattgatggcctcaatgtggcagacatcggcctccatgacctgcgctctcagctgaccatcatcccgcaggaccccatcctgttctcggggaccctgcgcatgaacctggaccccttcggcagctactcagaggaggacatttggtgggctttggagctgtcccacctgcacacgtttgtgagctcccagccggcaggcctggacttccagtgctcagagggcggggagaatctcagcgtgggccagaggcagctcgtgtgcctggcccgagccctgctccgcaagagccgcatcctggttttagacgaggccacagctgccatcgacctggagactgacaacctcatccaggctaccatccgcacccagtttgatacctgcactgtcctgaccatcgcacaccggcttaacactatcatggactacaccagggtcctggtcctggacaaaggagtagtagctgaatttgattctccagccaacctcattgcagctagaggcatcttctacgggatggccagagatgctggacttgcctaaaatatattcctgagatttcctcctggcctttcctggttttcatcaggaaggaaatgacaccaaatatgtccgcagaatggacttgatagcaaacactgggggcaccttaagattttgcacctgtaaagtgccttacagggtaactgtgctgaatgctttagatgaggaaatgatccccaagtggtgaatgacacgcctaaggtcacagctagtttgagccagttagactagtccccggtctcccgattcccaactgagtgttatttgcacactgcactgttttcaaataacgattttatgaaatgacctctgtcctccctctgatttttcatattttctaaagtttcgtttctgttttttaataaaaagctttttcctcctggaacagaagacagctgctgggtcaggccacccctaggaactcagtcctgtactctggggtgctgcctgaatccattaaaaatgggagtactgatgaaataaaactacatggtcaacagta

SEQ ID NO: 110183 - DNA, 5839 bp, Homo sapiens
  Payload ID: 1625
  Gene Symbol: ABCC4
  Gene Name: ATP-binding cassette, sub-family C (CFTR/MRP), member 4
  Uniprot ID: O15439
  ENST ID: ENST00000376887
  CDS Start-End: 116-4093
ggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagacattgctacaagtggttggtgtggtctctgtggctgtggccgtgattccttggatcgcaatacccttggttccccttggaatcattttcatttttcttcggcgatattttttggaaacgtcaagagatgtgaagcgcctggaatctacaactcggagtccagtgttttcccacttatcatcttctctccaggggctctggaccatccgggcatacaaagcagaagagaggtgtcaggaactgtttgatgcacaccaggatttacattcagaggcttggttcttgtttttgacaacgtcccgctggtttgccgtccgtctggatgccatctgtgccatgtttgtcatcatcgttgcctttgggtccctgattctggcaaaaactctggatgccgggcaggttggtttggcactgtcctatgccctcacgctcatggggatgtttcagtggtgtgttcgacaaagtgctgaagttgagaatatgatgatctcagtagaaagggtcattgaatacacagaccttgaaaaagaagcaccttgggaatatcagaaacgcccaccaccagcctggccccatgaaggagtgataatctttgacaatgtgaacttcatgtacagtccaggtgggcctctggtactgaagcatctgacagcactcattaaatcacaagaaaaggttggcattgtgggaagaaccggagctggaaaaagttccctcatctcagccctttttagattgtcagaacccgaaggtaaaatttggattgataagatcttgacaactgaaattggacttcacgatttaaggaagaagatgtcaatcatacctcaggaacctgttttgttcactggaacaatgaggaaaaacctggatccctttaatgagcacacggatgaggaactgtggaatgccttacaagaggtacaacttaaagaaaccattgaagatcttcctggtaaaatggatactgaattagcagaatcaggatccaattttagtgttggacaaagacaactggtgtgccttgccagggcaattctcaggaaaaatcagatattgattattgatgaagcgacggcaaatgtggatccaagaactgatgagttaatacaaaaaaaaatccgggagaaatttgcccactgcaccgtgctaaccattgcacacagattgaacaccattattgacagcgacaagataatggttttagattcaggaagactgaaagaatatgatgagccgtatgttttgctgcaaaataaagagagcctattttacaagatggtgcaacaactgggcaaggcagaagccgctgccctcactgaaacagcaaaacaggtatacttcaaaagaaattatccacatattggtcacactgaccacatggttacaaacacttccaatggacagccctcgaccttaactattttcgagacagcactgtgaatccaaccaaaatgtcaagtccgttccgaaggcattttccactagtttttggactatgtaaaccacattgtacttttttttactttggcaacaaatatttatacatacaagatgctagttcatttgaatatttctcccaacttatccaaggatctccagctctaacaaaatggtttatttttatttaaatgtcaatagttgttttttaaaatccaaatcagaggtgcaggccaccagttaaatgccgtctatcaggttttgtgccttaagagactacagagtcaaagctcatttttaaaggagtaggacaaagttgtcacaggtttttgttgttgtttttattgcccccaaaattacatgttaatttccatttatatcagggattctatttacttgaagactgtgaagttgccattttgtctcattgttttctttgacataactaggatccattatttcccctgaaggcttcttgttagaaaatagtacagttacaaccaataggaacaacaaaaagaaaaagtttgtgacattgtagtagggagtgtgtaccccttactccccatcaaaaaaaaaaatggatacatggttaaaggatagaagggcaatattttatcatatgttctaaaagagaaggaagagaaaatactactttctcaaaatggaagcccttaaaggtgctttgatactgaaggacacaaatgtgaccgtccatcctcctttagagttgcatgacttggacacggtaactgttgcagttttagactcagcattgtgacacttcccaagaaggccaaacctctaaccgacattcctgaaatacgtggcattattcttttttggatttctcatttatggaaggctaaccctctgttgactgtaagccttttggtttgggctgtattgaaatcctttctaaattgcatgaataggctctgctaacgtgatgagacaaactgaaaattattgcaagcattgactataattatgcagtacgttctcaggatgcatccaggggttcattttcatgagcctgtccaggttagtttactcctgaccactaatagcattgtcatttgggctttctgttgaatgaatcaacaaaccacaatacttcctgggaccttttgtactttatttgaactatgagtctttaatttttcctgatgatggtggctgtaatatgttgagttcagtttactaaaggttttactattatggtttgaagtggagtctcatgacctctcagaataaggtgtcacctccctgaaattgcatatatgtatatagacatgcacacgtgtgcatttgtttgtatacatatatttgtccttcgtatagcaagttttttgctcatcagcagagagcaacagatgttttattgagtgaagccttaaaaagcacacaccacacacagctaactgccaaaatacattgaccgtagtagctgttcaactcctagtacttagaaatacacgtatggttaatgttcagtccaacaaaccacacacagtaaatgtttattaatagtcatggttcgtattttaggtgactgaaattgcatcagtgatcataatgaggtttgttaaaacgatagctatattcaaaatgtctatatgtttatttggacttttgaggttaaagacagtcatataaacgtcctgtttctgttttaatgttatcatagaattttttaatgaaactaaattcaattgaaataaatgatagttttcatctccattcaga

SEQ ID NO: 110184 - DNA, 2840 bp, Homo sapiens
  Payload ID: 1625
  Gene Symbol: ABCC4
  Gene Name: ATP-binding cassette, sub-family C (CFTR/MRP), member 4
  Uniprot ID: O15439
  ENST ID: ENST00000536256
  CDS Start-End: 120-2474
gagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcacctatttaagtgtcttaacaatttttctattgagtactctgggtttttgttttgtttttcttactgatttgtagaattctttatgtattctgaattgcagataccttccttctgtactaatgcttatctttttagccctgtaatattgtgttttcataaacatacttatcaatcttttc

SEQ ID NO: 110185 - DNA, 2903 bp, Homo sapiens
  Payload ID: 1625
  Gene Symbol: ABCC4
  Gene Name: ATP-binding cassette, sub-family C (CFTR/MRP), member 4
  Uniprot ID: O15439
  ENST ID: ENST00000629385
  CDS Start-End: 133-2712
acaggctccagccgagcggacaggcgtggcggccggagccccagcatccctgcttgaggtccaggagcggagcccgcggccaccgccgcctgatcagcgcgaccccggcccgcgcccgccccgcccggcaagatgctgcccgtgtaccaggaggtgaagcccaacccgctgcaggacgcgaacctctgctcacgcgtgttcttctggtggctcaatcccttgtttaaaattggccataaacggagattagaggaagatgatatgtattcagtgctgccagaagaccgctcacagcaccttggagaggagttgcaagggttctgggataaagaagttttaagagctgagaatgacgcacagaagccttctttaacaagagcaatcataaagtgttactggaaatcttatttagttttgggaatttttacgttaattgaggaaagtgccaaagtaatccagcccatatttttgggaaaaattattaattattttgaaaattatgatcccatggattctgtggctttgaacacagcgtacgcctatgccacggtgctgactttttgcacgctcattttggctatactgcatcacttatatttttatcacgttcagtgtgctgggatgaggttacgagtagccatgtgccatatgatttatcggaaggcacttcgtcttagtaacatggccatggggaagacaaccacaggccagatagtcaatctgctgtccaatgatgtgaacaagtttgatcaggtgacagtgttcttacacttcctgtgggcaggaccactgcaggcgattgcagtgactgccctactctggatggagataggaatatcgtgccttgctgggatggcagttctaatcattctcctgcccttgcaaagctgttttgggaagttgttctcatcactgaggagtaaaactgcaactttcacggatgccaggatcaggaccatgaatgaagttataactggtataaggataataaaaatgtacgcctgggaaaagtcattttcaaatcttattaccaatttgagaaagaaggagatttccaagattctgagaagttcctgcctcagagggatgaatttggcttcatttttcagtgcaagcaaaatcatcgtgtttgtgaccttcaccacctacgtgctcctcggcagtgtgatcacagccagccgcgtgttcgtggcagtgacgctgtatggggctgtgcggctgacggttaccctcttcttcccctcagccattgagagggtgtcagaggcaatcgtcagcatccgaagaatccagacctttttgctacttgatgagatatcacagcgcaaccgtcagctgccgtcagatggtaaaaagatggtgcatgtgcaggattttactgctttttgggataaggcatcagagaccccaactctacaaggcctttcctttactgtcagacctggcgaattgttagctgtggtcggccccgtgggagcagggaagtcatcactgttaagtgccgtgctcggggaattggccccaagtcacgggctggtcagcgtgcatggaagaattgcctatgtgtctcagcagccctgggtgttctcgggaactctgaggagtaatattttatttgggaagaaatacgaaaaggaacgatatgaaaaagtcataaaggcttgtgctctgaaaaaggatttacagctgttggaggatggtgatctgactgtgataggagatcggggaaccacgctgagtggagggcagaaagcacgggtaaaccttgcaagagcagtgtatcaagatgctgacatctatctcctggacgatcctctcagtgcagtagatgcggaagttagcagacacttgttcgaactgtgtatttgtcaaattttgcatgagaagatcacaattttagtgactcatcagttgcagtacctcaaagctgcaagtcagattctgatattgaaagatggtaaaatggtgcagaaggggacttacactgagttcctaaaatctggtatagattttggctcccttttaaagaaggataatgaggaaagtgaacaacctccagttccaggaactcccacactaaggaatcgtaccttctcagagtcttcggtttggtctcaacaatcttctagaccctccttgaaagatggtgctctggagagccaagatacagagaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaatggaggaggaaatgtaaccgagaagctagatcttaactggtacttaggaatttattcaggtttaactgtagctaccgttctttttggcatagcaagatctctattggtattctacgtccttgttaactcttcacaaactttgcacaacaaaatgtttgagtcaattctgaaagctccggtattattctttgatagaaatccaataggaagaattttaaatcgtttctccaaagacattggacacttggatgatttgctgccgctgacgtttttagatttcatccagagatgggatctcgctgtgttgtcctggctggtctcaaactcctaggctcaagcaatcctcctccctcctcaagcaaacctcagtgctgggattataggcatgagccactgtacctggctaaatgttgtttttttgatattcaatttttgtttatagaattttcatttgttttgctcttatacttttcatctttttatgtttattgaccaattaaatatcatttgggtaagcaccta

SEQ ID NO: 110186 - DNA, 5712 bp, Homo sapiens
  Payload ID: 1626
  Gene Symbol: ABCC5
  Gene Name: ATP-binding cassette, sub-family C (CFTR/MRP), member 5
  Uniprot ID: O15440
  ENST ID: ENST00000265586
  CDS Start-End: 166-4350
cttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgt

SEQ ID NO: 110187 - DNA, 5921 bp, Homo sapiens
  Payload ID: 1626
  Gene Symbol: ABCC5
  Gene Name: ATP-binding cassette, sub-family C (CFTR/MRP), member 5
  Uniprot ID: O15440
  ENST ID: ENST00000334444
  CDS Start-End: 242-4555
gccgcgtccgcagccctgggcactcggaaggaggactacagttcccttcagccttgggaatgctttgtgcagcgcgcttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttgtaaaa

SEQ ID NO: 110188 - DNA, 1923 bp, Homo sapiens
  Payload ID: 1626
  Gene Symbol: ABCC5
  Gene Name: ATP-binding cassette, sub-family C (CFTR/MRP), member 5
  Uniprot ID: O15440
  ENST ID: ENST00000382494
  CDS Start-End: 116-742
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaaattttcaggatggctgtattctgcggtcagaatgagagagtcaagctgggcagaatctctcgccaagagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 110189 - DNA, 1848 bp, Homo sapiens
  Payload ID: 1626
  Gene Symbol: ABCC5
  Gene Name: ATP-binding cassette, sub-family C (CFTR/MRP), member 5
  Uniprot ID: O15440
  ENST ID: ENST00000392579
  CDS Start-End: 116-793
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccaccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 110190 - DNA, 883 bp, Homo sapiens
  Payload ID: 1626
  Gene Symbol: ABCC5
  Gene Name: ATP-binding cassette, sub-family C (CFTR/MRP), member 5
  ENST ID: ENST00000446941
  CDS Start-End: 166-327
cttgcgcggtgtggcggccgatgccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgagtcagagtctcactctgtcacccagactgtagtgcggtggcatgaccatggctcactgcagcgtcaaacacctgggctcctgtgatcctcctgcctcagcctcctgagtagctaggactacaatctcgtgccaccatgcctggctaacttttaaattttttatagtgatggggttttggagggttacacagactagtctcaaactcctggcctgaggccatcctcccacctcagcctcccaaagtgttgtgatgacaggcataagccactgtacactgcctactttttactttttaaatgtggctactagaaaaatttaaattacattatgtggcttacatttgcagcttgcattatatttctattggacagtgctgaactagagtgttgatctactgtaggttagccattgattttgtattaggcatttagatccctgtaagctgttgggtttaatgattttttcctttggaagattttcctttatgcagtaaaattatggagacacagagtatgtagtattacatattaccagtttgctctcctgaatccctgctggtagcatattaaaaatcagtttaatgttca

SEQ ID NO: 110191 - DNA, 591 bp, Homo sapiens
  Payload ID: 1626
  Gene Symbol: ABCC5
  Gene Name: ATP-binding cassette, sub-family C (CFTR/MRP), member 5
  ENST ID: ENST00000437341
  CDS Start-End: 150-591
cgggtctgagagaaacgcccacctgggaggctgtgcagcgggtggctcggggcaccctgctcaacccgcagcggagccgccagcgaccttcgaagaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaa

SEQ ID NO: 110192 - DNA, 5852 bp, Homo sapiens
  Payload ID: 1626
  Gene Symbol: ABCC5
  Gene Name: ATP-binding cassette, sub-family C (CFTR/MRP), member 5
  ENST ID: ENST00000437205
  CDS Start-End: 63-1484
ggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagccttcatggtgaaacacctcttggagtatacccaggcaacagagtctaacctgcagtacagcttgttgttagtgctgggcctcctcctgacggaaatcgtgcggtcttggtcgcttgcactgacttgggcattgaattaccgaaccggtgtccgcttgcggggggccatcctaaccatggcatttaagaagatccttaagttaaagaacattaaagagaaatccctgggtgagctcatcaacatttgctccaacgatgggcagagaatgtttgaggcagcagccgttggcagcctgctggctggaggacccgttgttgccatcttaggcatgatttataatgtaattattctgggaccaacaggcttcctgggatcagctgtttttatcctcttttacccagcaatgatgtttgcatcacggctcacagcatatttcaggagaaaatgcgtggccgccacggatgaacgtgtccagaagatgaatgaagttcttacttacattaaatttatcaaaatgtatgcctgggtcaaagcattttctcagagtgttcaaaaaatccgcgaggaggagcgtcggatattggaaaaagctgggtacttccagagcatcactgtgggtgtggctcccattgtggtggtgattgccagcgtggtgaccttctctgttcatatgaccctgggcttcgatctgacagcagcacaggctttcacagtggtgacagtcttcaattccatgacttttgctttgaaagtaacaccgttttcagtaaagtccctctcagaagcctcagtggctgttgacagatttaagcttccttccactgtatagcctgatgtgttttgctacgtgagtgtacgccctaggcttgtctccctggtcttgatccagtgtctcatctttgcacctctctcacaactcctatcagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagagggtaaactggttggaatctgtggcagtgtgggaagtggaaaaacctctctcatttcagccattttaggccagatgacgcttctagagggcagcattgcaatcagtggaaccttcgcttatgtggcccagcaggcctggatcctcaatgctactctgagagacaacatcctgtttgggaaggaatatgatgaagaaagatacaactctgtgctgaacagctgctgcctgaggcctgacctggccattcttcccagcagcgacctgacggagattggagagcgaggagccaacctgagcggtgggcagcgccagaggatcagccttgcccgggccttgtatagtgacaggagcatctacatcctggacgaccccctcagtgccttagatgcccatgtgggcaaccacatcttcaatagtgctatccggaaacatctcaagtccaagacagttctgtttgttacccaccagttacagtacctggttgactgtgatgaagtgatcttcatgaaagagggctgtattacggaaagaggcacccatgaggaactgatgaatttaaatggtgactatgctaccatttttaataacctgttgctgggagagacaccgccagttgagatcaattcaaaaaaggaaaccagtggttcacagaagaagtcacaagacaagggtcctaaaacaggatcagtaaagaaggaaaaagcagtaaagccagaggaagggcagcttgtgcagctggaagagaaagggcagggttcagtgccctggtcagtatatggtgtctacatccaggctgctgggggccccttggcattcctggttattatggcccttttcatgctgaatgtaggcagcaccgccttcagcacctggtggttgagttactggatcaagcaaggaagcgggaacaccactgtgactcgagggaacgagacctcggtgagtgacagcatgaaggacaatcctcatatgcagtactatgccagcatctacgccctctccatggcagtcatgctgatcctgaaagccattcgaggagttgtctttgtcaagggcacgctgcgagcttcctcccggctgcatgacgagcttttccgaaggatccttcgaagccctatgaagttttttgacacgacccccacagggaggattctcaacaggttttccaaagacatggatgaagttgacgtgcggctgccgttccaggccgagatgttcatccagaacgttatcctggtgttcttctgtgtgggaatgatcgcaggagtcttcccgtggttccttgtggcagtggggccccttgtcatcctcttttcagtcctgcacattgtctccagggtcctgattcgggagctgaagcgtctggacaatatcacgcagtcacctttcctctcccacatcacgtccagcatacagggccttgccaccatccacgcctacaataaagggcaggagtttctgcacagataccaggagctgctggatgacaaccaagctcctttttttttgtttacgtgtgcgatgcggtggctggctgtgcggctggacctcatcagcatcgccctcatcaccaccacggggctgatgatcgttcttatgcacgggcagattcccccagcctatgcgggtctcgccatctcttatgctgtccagttaacggggctgttccagtttacggtcagactggcatctgagacagaagctcgattcacctcggtggagaggatcaatcactacattaagactctgtccttggaagcacctgccagaattaagaacaaggctccctcccctgactggccccaggagggagaggtgacctttgagaacgcagagatgaggtaccgagaaaacctccctctcgtcctaaagaaagtatccttcacgatcaaacctaaagagaagattggcattgtggggcggacaggatcagggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaagagaccatccgagaagcatttgcagactgtaccatgctgaccattgcccatcgcctgcacacggttctaggctccgataggattatggtgctggcccagggacaggtggtggagtttgacaccccatcggtccttctgtccaacgacagttcccgattctatgccatgtttgctgctgcagagaacaaggtcgctgtcaagggctgactcctccctgttgacgaagtctcttttctttagagcattgccattccctgcctggggcgggcccctcatcgcgtcctcctaccgaaaccttgcctttctcgattttatctttcgcacagcagttccggattggcttgtgtgtttcacttttagggagagtcatattttgattattgtatttattccatattcatgtaaacaaaatttagtttttgttcttaattgcactctaaaaggttcagggaaccgttattataattgtatcagaggcctataatgaagctttatacgtgtagctatatctatatataattctgtacatagcctatatttacagtgaaaatgtaagctgtttattttatattaaaataagcactgtgctaataacagtgcatattcctttctatcatttttgtacagtttgctgtactagagatctggttttgctattagactgtaggaagagtagcatttcattcttctctagctggtggtttcacggtgccaggttttctgggtgtccaaaggaagacgtgtggcaatagtgggccctccgacagccccctctgccgcctccccacggccgctccaggggtggctggagacgggtgggcggctggagaccatgcagagcgccgtgagttctcagggctcctgccttctgtcctggtgtcacttactgtttctgtcaggagagcagcggggcgaagcccaggccccttttcactccctccatcaagaatggggatcacagagacattcctccgagccggggagtttctttcctgccttcttctttttgctgttgtttctaaacaagaatcagtctatccacagagagtcccactgcctcaggttcctatggctggccactgcacagagctctccagctccaagacctgttggttccaagccctggagccaactgctgctttttgaggtggcactttttcatttgcctattcccacacctccacagttcagtggcagggctcaggatttcgtgggtctgttttcctttctcaccgcagtcgtcgcacagtctctctctctctctcccctcaaagtctgcaactttaagcagctcttgctaatcagtgtctcacactggcgtagaagtttttgtactgtaaagagacctacctcaggttgctggttgctgtgtggtttggtgtgttcccgcaaaccccctttgtgctgtggggctggtagctcaggtgggcgtggtcactgctgtcatcaattgaatggtcagcgttgcatgtcgtgaccaactagacattctgtcgccttagcatgtttgctgaacaccttgtggaagcaaaaatctgaaaatgtgaataaaattattttggattttg

SEQ ID NO: 110193 - DNA, 550 bp, Homo sapiens
  Payload ID: 1626
  Gene Symbol: ABCC5
  Gene Name: ATP-binding cassette, sub-family C (CFTR/MRP), member 5
  ENST ID: ENST00000443497
  CDS Start-End: 1-212
ccttcacgatcaaacctaaagagaagattggcattgtggggcggacaggatcagaacactggggcacacagccaagtacgaaagaggagcagcacccacaactctgctacccagagagaagcactggtaacattttgggaagtcctcgctggggatggccctcttccgtctggtggagttatctggaggctgcatcaagattgatggagtgagaatcagtgatattggccttgccgacctccgaagcaaactctctatcattcctcaagagccggtgctgttcagtggcactgtcagatcaaatttggaccccttcaaccagtacactgaagaccagatttgggatgccctggagaggacacacatgaaagaatgtattgctcagctacctctgaaacttgaatctgaagtgatggagaatggggataacttctcagtgggggaacggcagctcttgtgcatagctagagccctgctccgccactgtaagattctgattttagatgaagccacagctgccatggacacagagacagacttattgattcaa

SEQ ID NO: 110194 - DNA, 4697 bp, Homo sapiens
  Payload ID: 1626
  Gene Symbol: ABCC5
  Gene Name: ATP-binding cassette, sub-family C (CFTR/MRP), member 5
  ENST ID: ENST00000427120
  CDS Start-End: 90-785
cggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagtaagttctaaccatcctttccgacagtctccaggggcccggccacggccagctctaacactcttattctgttgcagaggttgtgctcagctttgggctaggtagcagtcttagagatgccttcaggtctgttgaaaggggtcgatggattttggcaacagctggaaggatgaaagggcagtgttgccagagaagaaatggaactggcttgatttctgggtgggggtgaaatggaactgactccagttctgcacaggactgtgcttctcggttgtgtgttaacatgaactgacagtcggtgcaggcagatgtgtcttgcagtgctatgagtgggtgagagcacgttgtgtggcccgggctggtgagccagcaccgggaacataccaagtgcctggaggcagttatcacatgtttggcaggtctgtggcaaataagccctgagaaaactagaggactgtcgaggattttagagtctgacctggagtccgtttaagtttggcttatagtgtgactgtgtggcaagtgttggggtggcagccgtggttttccccagtctgtactgatgcagagtagacaagagagcctttgacgttcactctgtttcctgggcacctgtttcttacacctgctgtgctgccttacacttgagaccttgattaaatctattctctacacatttgccttgaggcatcggagcagtagtactgcttgtactgtgcgttttccatatgtgggtaagctggaggttcatggttttggtaagtatgtgcctaagatgcatggcaattaggtaaaactaatttgcagttttgtttttgtttttatttttttaacgtttgatgcctcttgttaaagttttgatctcttttctgaagcagagaacactacttttctggtattgggtttctatattattaataattgaccaactaacatactttatataaaagttttaagtaagaaggaccatgtaactgaaatgttgtgttatgtaatttaccaaaatggcaaacattttcatagagccagcttcccccaagaagagcttctgtcattgtttcactacagggctggtggctgctctgatctcatagaattcattcctctgggtagcaccatatgcaggctttgcgaataaagtgatcatgggctttcttgattccatttggccaatgcaagaacttcattggctcccctctaaaaaaaattccatggattgctgggatttttattttttattttttgaaaaaaatggtacctatccgtattcagcttggtggcttcacagtccctcccctgaacatccgtatattccttattctctcatttatggtgcagaacactggggtactaacctctaggaaactgttctagctgccagggaaagctaagagccctcctttaacaggaaagcagcagcatgctttttcttctctctgccgtttcagggaagagcaccttaaggccagtgttatttcatgggattctgccctagagctgagaaagtaatggactcatccataatctcttttatagatttgaaagtgtaaacaatacacacttccttttttggaactccaattctaatatgtttctttttcattggaaattgaaaaaccaggctggttttgagattagtactagcagtgagtaaacctcctgtctgtggacttaaatccttttgaggaacatttcgttttagatttttacaagttttctaatctggcacgactttcaaactagcttaatctgttcttacagaaacctgtgtaaggacagactgcccacatacgggctccccaaataaaatggcatttttatttcttgtccctgctcgggtttcaccgaaccttggtagccataatcagaacaaatgaaacacagtcaagttgttgtgttctgtttgtttttacctgccagccagctgatgctgacatttatacaccaagatgatccaaggttttggtgacgccggtggggactgccgctatatgtgcagggtgcccgggggtcatagtaatgttaatggagtaccagaatctctaacagtgtggtcctgtgtagccacattgctacacttacagagatgctttggggcctttttggattaagacagttctaaaagaccaggcctcacctatgatctgtgtataaagaattagcatcgcactgtagatctgcaagagaaggccgcctcctgcagtgctctctcttggtgaatgctaactctgctcgagggccttttggggaaaggacagtgtaaaacccttagagaggtaagtttcccacccttccaacctctctccacctgcagcttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcaggtaaggtaatgtttattcactgggaatgctttccacagccagacagctatgctaacagtctcaagttttcttccagtttgtttagatttaaatgatacatttgtaactttttaaaaactaaattttggttggatttttcatgaaaacctcttttttctttatcccctaaaaaatggtttgaaatgtcattgttatttaaaaacccgatgtgttggaacttctttaatctgctgtttcctctttttccccccctttgaaagtttcgcatagtgtaaacattcactatgtcttttaccttccctgctcctcccatctgggaggcgctgatgctattacccagtgctgaaaaatggcactctaaaggtatgggaaggaaggagcccaaggcaaccacctgctgtcctttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 110195 - DNA, 821 bp, Homo sapiens
  Payload ID: 1626
  Gene Symbol: ABCC5
  Gene Name: ATP-binding cassette, sub-family C (CFTR/MRP), member 5
  ENST ID: ENST00000438979
  CDS Start-End: 143-304
ccgctataaaggcttgttttgctgcagggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgaggcactctcactgttggccaggctgttgttgaactcccagcttcaagcaagcctcccgcctcagcctcccaaagtgctgggattacagttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggacc

SEQ ID NO: 110196 - DNA, 2000 bp, Homo sapiens
  Payload ID: 1626
  Gene Symbol: ABCC5
  Gene Name: ATP-binding cassette, sub-family C (CFTR/MRP), member 5
  Uniprot ID: O15440
  ENST ID: ENST00000443376
  CDS Start-End: 116-754
ggctcatgctcgggagcgtggttgagcggctggcgcggttgtcctggagcaggggcgcaggaattctgatgtgaaactaacagtctgtgagccctggaacctccactcagagaagatgaaggatatcgacataggaaaagagtatatcatccccagtcctgggtatagaagtgtgagggagagaaccagcacttctgggacgcacagagaccgtgaagattccaagttcaggagaactcgaccgttggaatgccaagatgccttggaaacagcagcccgagccgagggcctctctcttgatgcctccatgcattctcagctcagaatcctggatgaggagcatcccaagggaaagtaccatcatggcttgagtgctctgaagcccatccggactacttccaaacaccagcacccagtggacaatgctgggcttttttcctgtatgactttttcgtggctttcttctctggcccgtgtggcccacaagaagggggagctctcaatggaagacgtgtggtctctgtccaagcacgagtcttctgacgtgaactgcagaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccacttgcttggtgctgtcaggatctggatttggggggagtctctctgtagtggaaccagtgacagaagctgttctttagaattttcaggatggctgtattctgcggtcagaatgagagagtcaagctgggcagaatctctcgccaagagttcagccttcctttggagactgctccatcagtgccgaggtgtgtgggaacaggcttcactgcaccgccatcttactgagttgcttcacgtgaggaaaagggggctttggccctgtgactcagttccacattttggattgcatactggaaaagaagccaatcttcttgctagtaaaccagcaacccggctgtatacagtggtgacccaagcaatggatataaacctaaaaatctgagggaggggagaggtggaatacagtagttcttggaatctgaagtctcctatttgatcaggttatttcctgggacttggcaaaaatctgattggtggggatctcctaggacctagtggacatctggtattaatttaatctcaggaaaaacaagaaattaacccagagagagtctgggttttggaattcagcgtagctacctccagaccgtggtgtctggcctccatttttgtctgtcattcagctctgacttacagctgcagtcacctttgctataaggcacctgggtagaagggtggatgggcttcacatcaatttttttcttcctttagggtgggggattggtttggctttcttttgttgtggttttttgttttatttttgtcaagattgatttttagatgcaaggacttgaaaagacccagaaggatgccaccagtttttccttgaggcctaggattttttattctgtcccgagcagaggtaattcctcacaacttagtgcaccagtagcaccagccattttgagcagagtacctctttggggagcttttcgttttgttttgtttttaattctctttccttagcagcaaggtcttttttcctagagaatctactccgttgcagaatcattgcaacctcaggagccctcactgattgagtgctgtcagcctgatatactactttggactctggaaacagatatgggttctattctctatttctactgtgtgtcgttaaacaaccgtcggagaccagatgacctgttagatggctagtcctgtataactcgactctgtatgtttcaatgtatgttactgcaatgcttcacctgctgtacagtgtttgtgagatgctctttgaagatggtacttttatattttttcattttcaataaaagtacattccttccca

SEQ ID NO: 110197 - DNA, 5747 bp, Homo sapiens
  Payload ID: 1627
  Gene Symbol: ABCC6
  Gene Name: ATP-binding cassette, sub-family C (CFTR/MRP), member 6
  Uniprot ID: O95255
  ENST ID: ENST00000205557
  CDS Start-End: 31-4542
cgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaacacggattctcgtgacgcacgcactccacatcctgccccaggctgattggatcatagtgctggcaaatggggccatcgcagagatgggttcctaccaggagcttctgcagaggaagggggccctcatgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtactcctgtgtgtgtgtgtgtttattttgtcccatgcagttttatcacacatgtaggctcatgaatccacaccagggtgaggatacggaatagccaccaccattttccgaccacacccatcactctcgctcctgcccccagtgaccatgctctgttctccagttgtgtgtgtgtgtgtgtgtgtgtgtgtgtgtattttttttttttttttttttgagacagagtctcactctgttgctcaggctggagtgcagtggctcaatctcagctcactgcaacctccacatcctgggttcaagcaattctcctgcctcagcctcccgtgcagctgagattacaggcgtgcgccaccatgcctggctaacttgtgtaatttttattagatacgaggtttcagcatattggccaggctggtcttgaactcctggcctcatgtgatccaccctcctcggcctcccaaagtgttgggataacaggcgtgagctaccgcacctggccgagtttggtgtataattttaaagctcccccataggattccaatgtgcggccaggactgagaactacagccctcgcatctcctgctgctcctcctcccccaccagagatgagctccaaggacacaaaaaccaggtgcccccc

SEQ ID NO: 110198 - DNA, 4137 bp, Homo sapiens
  Payload ID: 1627
  Gene Symbol: ABCC6
  Gene Name: ATP-binding cassette, sub-family C (CFTR/MRP), member 6
  Uniprot ID: O95255
  ENST ID: ENST00000456970
  CDS Start-End: 1-2616
atggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctga

SEQ ID NO: 110199 - DNA, 1381 bp, Homo sapiens
  Payload ID: 1627
  Gene Symbol: ABCC6
  Gene Name: ATP-binding cassette, sub-family C (CFTR/MRP), member 6
  ENST ID: ENST00000577103
  CDS Start-End: 89-337
ctcttctccggcaggatcgcggccgagcagtctgcccagagacttagcgacagacagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatgagaaaccaaaatatattagagagaccctagagacttactggcccaacagagagttgctccttgatttcatagcagggattgaaaaatgacttggagaaaggatagttttttacctggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaagg

SEQ ID NO: 110200 - DNA, 714 bp, Homo sapiens
  Payload ID: 1627
  Gene Symbol: ABCC6
  Gene Name: ATP-binding cassette, sub-family C (CFTR/MRP), member 6
  Uniprot ID: O95255
  ENST ID: ENST00000575728
  CDS Start-End: 34-333
agacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtagctgccatccctgggagcctggaaccaggcaatgttcgggggaggcaggggacaggctggaacctggtgaagtcttaaagtagactcctcctatcggggtgtagaagggaatctgttaatcaaacagagcaatattagaaaggctacagaggtcaactcagtggaacacggttctcccaaacagattttgtaattccgaaaatccacgcatgcgcaaacatacgcatacactcccatgttcctggacagtttatagctaccataacctggcattttccaaaacataccatgtagactcttggatacacaaggtaattttagagccacattaggatgaaccttttaaaaagttatgcatttatttttatgttcccccactggctgtattataggacaatttttatatgtgatatgtatttaccttagtgtgttaaataaacactggcattccaagtgtga

SEQ ID NO: 110201 - DNA, 5753 bp, Homo sapiens
  Payload ID: 1627
  Gene Symbol: ABCC6
  Gene Name: ATP-binding cassette, sub-family C (CFTR/MRP), member 6
  ENST ID: ENST00000620078
  CDS Start-End: 31-4542
cgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaacctggtgtccgtagacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgccgtagactcaagttcctctggaagcgctgccgggaaggattgcatcacgatacaaagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtgggctactccagggaacaacacggattctcgtgacgcacgcactccacatcctgccccaggctgattggatcatagtgctggcaaatggggccatcgcagagatgggttcctaccaggagcttctgcagaggaagggggccctcgtgtgtcttctggatcaagccagacagccaggagatagaggagaaggagaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccaggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgtactcctgtgtgtgtgtgtgtttattttgtcccatgcagttttatcacacatgtaggctcatgaatccacaccagggtgaggatacggaatagccaccaccattttccgaccacacccatcactctcgctcctgcccccagtgaccatgctctgttctccagttgtgtgtgtgtgtgtgtgtgtgtgtgtgtgtgtgtgtattttttttttttttttttttgagacagagtctcactctgttgctcaggctgaagtgcagtggctcaatctcagctcactgcaacctccacatcctgggttcaagcaattctcctgcctcagcctcccgtgcagctgagattacaggcgtgcgccaccatgcctggctaacttgtgtaatttttattagatacgaggtttcagcatattggccaggctggtcttgaactcctggcctcatgtgatccaccctcctcggcctcccaaagtgttgggataacaggcgtgagctaccgcacctggccgagtttggtgtataattttaaagctcccccataggattccaatgtgcggccaggactgagaactacagccctcgcatctcctgctgctcctcctcccccaccagagatgagctccaaggacacaaaaaccaggtgcccccc

SEQ ID NO: 110202 - DNA, 714 bp, Homo sapiens; identical to SEQ ID NO: 110200
  Payload ID: 1627
  Gene Symbol: ABCC6
  Gene Name: ATP-binding cassette, sub-family C (CFTR/MRP), member 6
  Uniprot ID: O95255
  ENST ID: ENST00000600761
  CDS Start-End: 34-333

SEQ ID NO: 110203 - DNA, 4941 bp, Homo sapiens
  Payload ID: 1627
  Gene Symbol: ABCC6
  Gene Name: ATP-binding cassette, sub-family C (CFTR/MRP), member 6
  Uniprot ID: O95255
  ENST ID: ENST00000622290
  CDS Start-End: 38-2653
agacagacgctgggacccacgacgacagaaggcgccgatggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaatctggtgtccgtggacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgtcgtagactcaagttcctctggaagcgctgccgggaaggattgcatcaccatacacagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtggactactccagggaacaaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcagagcctgtatgtggttagctcatgccagctgagacgcttggagtcagccagctactcgtctgtctgctcccacatggctgagacgttccagggcagcacagtggtccgggcattccgaacccaggccccctttgtggctcagaacaatgctcgcgtagatgaaagccagaggatcagtttcccgcgactggtggctgacaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccgggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctgagccaggaccctcaaccgtaccccagttggaccagcccgcacagcctgcagtgctggagatggaagtgacccgtggtcatcgatagctccacacgatattgagtctagacctgtgtttgctctctgggaggaaaatggcagagaaagtggccaattatcacagagcatcagagccggaaggacctagcaatacacaggtctgcccgggcagggcccatctcgccctgtccaccctgcagccaatgtcaacagcgactctcagccccgctgtactctggactcacctgggggcctcaagcacatgcccaggctcccggctagacccttaaatcagaatctctgaggctgggaactgccatgctgtgtgtactttttacaaattaacacttttattttgggataatcccagactcacatgcagttaaagaaacaataatatagagagattcgtgtacttggtaccccatttcacccaatggtaacatcttgcaaaactctaggataaagcatcacagccagggtgttgacattgacacaacaatcttgctcgatttcccgttttacctgt

SEQ ID NO: 110204 - DNA, 4137 bp, Homo sapiens
  Payload ID: 1627
  Gene Symbol: ABCC6
  Gene Name: ATP-binding cassette, sub-family C (CFTR/MRP), member 6
  ENST ID: ENST00000633611
  CDS Start-End: 1-2616
atggccgcgcctgctgagccctgcgcggggcagggggtctggaaccagacagagcctgaacctgccgccaccagcctgctgagcctgtgcttcctgagaacagcaggggtctgggtaccccccatgtacctctgggtccttggtcccatctacctcctcttcatccaccaccatggccggggctacctccggatgtccccactcttcaaagccaagatggtgcttggattcgccctcatagtcctgtgtacctccagcgtggctgtcgctctttggaaaatccaacagggaacgcctgaggccccagaattcctcattcatcctactgtgtggctcaccacgatgagcttcgcagtgttcctgattcacaccgagaggaaaaagggagtccagtcatctggagtgctgtttggttactggcttctctgctttgtcttgccagctaccaacgctgcccagcaggcctccggagcgggcttccagagcgaccctgtccgccacctgtccacctacctatgcctgtctctggtggtggcacagtttgtgctgtcctgcctggcggatcaaccccccttcttccctgaagacccccagcagtctaacccctgtccagagactggggcagccttcccctccaaagccacgttctggtgggtttctggcctggtctggaggggatacaggaggccactgagaccaaaagacctctggtcgcttgggagagaaaactcctcagaagaacttgtttcccggcttgaaaaggagtggatgaggaaccgcagtgcagcccggaggcacaacaaggcaatagcatttaaaaggaaaggcggcagtggcatgaaggctccagagaccgagcccttcctacggcaagaagggagccagtggcgcccactgctgaaggccatctggcaggtgttccattctaccttcctcctggggaccctcagcctcatcatcagtgatgtcttcaggttcactgtccccaagctgctcagccttttcctggagtttattggtgatcccaagcctccagcctggaagggctacctcctcgccgtgctgatgttcctctcagcctgcctgcaaacgctgtttgagcagcagaacatgtacaggctcaaggtgctgcagatgaggttgcggtcggccatcactggcctggtgtacagaaaggtcctggctctgtccagcggctccagaaaggccagtgcggtgggtgatgtggtcaacctggtgtccgtagacgtgcagcggctgaccgagagcgtcctctacctcaacgggctgtggctgcctctcgtctggatcgtggtctgcttcgtctatctctggcagctcctggggccctccgccctcactgccatcgctgtcttcctgagcctcctccctctgaatttcttcatctccaagaaaaggaaccaccatcaggaggagcaaatgaggcagaaggactcacgggcacggctcaccagctctatcctcaggaactcgaagaccatcaagttccatggctgggagggagcctttctggacagagtcctgggcatccgaggccaggagctgggcgccttgcggacctccggcctcctcttctctgtgtcgctggtgtccttccaagtgtctacatttctggtcgcactggtggtgtttgctgtccacactctggtggccgagaatgctatgaatgcagagaaagcctttgtgactctcacagttctcaacatcctcaacaaggcccaggctttcctgcccttctccatccactccctcgtccaggcccgggtgtcctttgaccgtctggtcaccttcctctgcctggaagaagttgaccctggtgccgtagactcaagttcctctggaagcgctgccgggaaggattgcatcacgatacaaagtgccaccttcgcctggtcccaggaaagccctccctgcctccacagaataaacctcacggtgccccagggctgtctgctggctgttgtcggtccagtgggggcagggaagtcctccctgctgtccgccctccttggggagctgtcaaaggtggaggggttcgtgagcatcgagggtgctgtggcctacgtgccccaggaggcctgggtgcagaacacctctgtggtagagaatgtgtgcttcgggcaggagctggacccaccctggctggagagagtactagaagcctgtgccctgcagccagatgtggacagcttccctgagggaatccacacttcaattggggagcagggcatgaatctctccggaggccagaagcagcggctgagcctggcccgggctgtatacagaaaggcagctgtgtacctgctggatgaccccctggcggccctggatgcccacgttggccagcatgtcttcaaccaggtcattgggcctggtgggctactccagggaacaaaacagaacctgggaccagcaccaaggaccccagaggcacctctgcaggcaggaggcccgagcttagacgcgagaggtccatcaagtcagtccctgagaaggaccgtaccacttcagaagcccagacagaggttcctctggatgaccctgacagggcaggatggccagcaggaaaggacagcatccaatacggcagggtgaaggccacagtgcacctggcctacctgcgtgccgtgggcacccccctctgcctctacgcactcttcctcttcctctgccagcaagtggcctccttctgccggggctactggctgagcctgtgggcggacgaccctgcagtaggtgggcagcagacgcaggcagccctgcgtggcgggatcttcgggctcctcggctgtctccaagccattgggctgtttgcctccatggctgcggtgctcctaggtggggcccgggcatccaggttgctcttccagaggctcctgtgggatgtggtgcgatctcccatcagcttctttgagcggacacccattggtcacctgctaaaccgcttctccaaggagacagacacggttgacgtggacattccagacaaactccggtccctgctgatgtacgcctttggactcctggaggtcagcctggtggtggcagtggctaccccactggccactgtggccatcctgccactgtttctcctctacgctgggtttcaggtggcttgcggccaatgtggagctcctggggaatggcctggtgtttgcagctgccacgtgtgctgtgctgagcaaagcccacctcagtgctggcctcgtgggcttctctgtctctgctgccctccaggtgacccagacactgcagtgggttgttcgcaactggacagacctagagaacagcatcgtgtcagtggagcggatgcaggactatgcctggacgcccaaggaggctccctggaggctgcccacatgtgcagctcagcccccctggcctcagggcgggcagatcgagttccaggactttgggctaagataccgacctgagctcccgctggctgtgcagggcgtgtccttcaagatccacgcaggagagaaggtgggcatcgttggcaggaccggggcagggaagtcctccctggccagtgggctgctgcggctccaggaggcagctgagggtgggatctggatcgacggggtccccattgcccacgtggggctgcacacactgcgctccaggatcagcatcatcccccaggaccccatcctgttccctggctctctgcggatgaacctcgacctgctgcaggagcactcggacgaggctatctgggcagccctggagacggtgcagctcaaagccttggtggccagcctgcccggccagctgcagtacaagtgtgctgaccgaggcgaggacctgagcgtgggccagaaacagctcctgtgtctggcacgtgcccttctccggaagacccagatcctcatcctggacgaggctactgctgccgtggaccctggcacggagctgcagatgcaggccatgctcgggagctggtttgcacagtgcactgtgctgctcattgcccaccgcctgcgctccgtgatggactgtgcccgggttctggtcatggacaaggggcaggtggcagagagcggcagcccggcccagctgctggcccagaagggcctgttttacagactggcccaggagtcaggcctggtctga

SEQ ID NO: 110205 - DNA, 1381 bp, Homo sapiens; identical to SEQ ID NO: 110199
  Payload ID: 1627
  Gene Symbol: ABCC6
  Gene Name: ATP-binding cassette, sub-family C (CFTR/MRP), member 6
  ENST ID: ENST00000632157
  CDS Start-End: 89-337

SEQ ID NO: 110206 - DNA, 4923 bp, Homo sapiens
  Payload ID: 1628
  Gene Symbol: ABCC8
  Gene Name: ATP-binding cassette, sub-family C (CFTR/MRP), member 8
  Uniprot ID: Q09428
  ENST ID: ENST00000302539
  CDS Start-End: 70-4818
agaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcct

SEQ ID NO: 110207 - DNA, 4921 bp, Homo sapiens
  Payload ID: 1628
  Gene Symbol: ABCC8
  Gene Name: ATP-binding cassette, sub-family C (CFTR/MRP), member 8
  Uniprot ID: Q09428
  ENST ID: ENST00000389817
  CDS Start-End: 70-4815
agaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatcgcccctggacagaagatcgggatctgcggccgcaccggcagtgggaagtcctccttctctcttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 110208 - DNA, 4283 bp, Homo sapiens
  Payload ID: 1628
  Gene Symbol: ABCC8
  Gene Name: ATP-binding cassette, sub-family C (CFTR/MRP), member 8
  ENST ID: ENST00000527905
  CDS Start-End: 44-3037
gcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccctgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagttcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgctgtccaaaggcacctactggtggatgaacgccttcatcaagactgcccacaagaagcccatcgacttgcgagccatcgggaagctgcccatcgccatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccacgtcagcttcttcaaagaggccgacttctcgccctccgtggcctttgcctccctctccctcttccatatcttggtcacaccgctgttcctgctgtccagtgtggtccgatctaccgtcaaagctctagtgagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatggcaccatccagagggagggtaccctcaaggacttccagaggtctgaatgccagctctttgagcactggaagaccctcatgaaccgacaggaccaagagctggagaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctggccatcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctgggtgagaggctcagggagaggggtggggaagagtccaaggaggagtgtgtctgggttgggggccacaagggagcctggggatggggtggcactttcggatactagctgtggcccatgcctggtggctgagcccagcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaaggtcagagcacgggcccaacccaatgctgcaggacaggcgtgagcaggggatggggcatgcacggagctggatggcttcgcagtcacctcgtggccctccagggcc

SEQ ID NO: 110209 - DNA, 611 bp, Homo sapiens
  Payload ID: 1628
  Gene Symbol: ABCC8
  Gene Name: ATP-binding cassette, sub-family C (CFTR/MRP), member 8
  ENST ID: ENST00000528374
  CDS Start-End: 1-611
ccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcccggcccccagcaccatcgctgatcccaaagaactggccagaccaagggaagatccagatccagaacctgagcgtgcgctacgacagctccctgaagccggtgctgaagcacgtcaatgccctcatcgcccctggacagaagatcgggatct

SEQ ID NO: 110210 - DNA, 440 bp, Homo sapiens
  Payload ID: 1628
  Gene Symbol: ABCC8
  Gene Name: ATP-binding cassette, sub-family C (CFTR/MRP), member 8
  ENST ID: ENST00000531891
  CDS Start-End: 1-161
caccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggaccaagggaagatccagatccagaacctgagcgtgcgctacgacagctccctgaagccggtgctgaagcacgtcaatgccctca

SEQ ID NO: 110211 - DNA, 883 bp, Homo sapiens
  Payload ID: 1628
  Gene Symbol: ABCC8
  Gene Name: ATP-binding cassette, sub-family C (CFTR/MRP), member 8
  ENST ID: ENST00000531642
  CDS Start-End: 1-187
cttgccttcttccgcatggtggacacgttcgaagggcacatcatcattgatggcattgacatcgccaaactgccgctgcacaccctgcgctcacgcctctccatcatcctgcaggaccccgtcctcttcagcggcaccatccggcccaggcagcctctggaaggggatcccccacccatgggtctaagatgctgtcccccacccactgccaccacctcggtgcttctcccagccagacctccaactcagtctgctctcgctcactgccctctttgccgcctggggatgcaggcaggaccctgctccctccctactggggctttctgtgccacttccagatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttccta

SEQ ID NO: 110212 - DNA, 537 bp, Homo sapiens
  Payload ID: 1628
  Gene Symbol: ABCC8
  Gene Name: ATP-binding cassette, sub-family C (CFTR/MRP), member 8
  ENST ID: ENST00000526168
  CDS Start-End: 1-101
gccgcaccggcagtgggaagtcctccttctctcttgccttcttccgcatggtggacacgttcgaaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacct

SEQ ID NO: 110213 - DNA, 183 bp, Homo sapiens
  Payload ID: 1628
  Gene Symbol: ABCC8
  Gene Name: ATP-binding cassette, sub-family C (CFTR/MRP), member 8
  Uniprot ID: Q09428
  ENST ID: ENST00000612903
  CDS Start-End: 3-155
ccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattgggtgaccgaatcccaccatctgcacctgtacat

SEQ ID NO: 110214 - DNA, 8293 bp, Homo sapiens
  Payload ID: 1629
  Gene Symbol: ABCC9
  Gene Name: ATP-binding cassette, sub-family C (CFTR/MRP), member 9
  Uniprot ID: O60706
  ENST ID: ENST00000261200
  CDS Start-End: 1-4650
atgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcatcgagtacacactattctgacggcagacctggttattgtgatgaagcgaggaaatattttagaatatgacactccagaaagcctcttggctcaggaaaatggagtatttgcttcttttgttcgcgcagacatgtgaaggagtgtcttaaaacaatacatgtatttaaaataatgcagtcataacctaattaatggatcatcagcttgacctctgtaaagtggcatcttaaaacttttacagatttttgcacaaaaagtggacatttatttttcctgtttttaaaacagtttttcaagatattattgcttaatatgttcattattgatgtttttatagtgatccagccactctagctttaagaatagctaggttgtattaaaacatgtaagctactttaagtgataaatcaatagctaaagttttctcctaactttaagtctggtaaatatctctcaggaatggaagtgtcaatgagtagtcagtattactatactcttgtttgtaagaatatattttccttattgttggagtctccagaggttattggaaggaataaaaaaggacatgttttctaacgaaactctcaaattcattatctacttcatgagaatttatttgtattcattaacattagtaatacctatttttcttaagagccttcttttttcccttttgtttcttgtcaccaagaagttatcacacttatacttattctataaggccaaagccttatctagaaagatcatgaagagtttggatatttttaaaactatactcgaattttcattttttcctgtcctgtaaagagagaattcttaagatatcaggcataatgtatgtaccttttccagactgaagttcaaagaatgattaggttcaatctttcagtggcaggccagctaaactttctatagtttaatgattagctgtggttatgatcttgagccctaacatgccacattactcaagatttacacaggcaagtgacttcatttggcactgctaataatggcaggtgaacattcctctcaggtgtgagatatttcctatgaaacagtccactggcaggctggagatatcttacactttgaagttatatatatataaaacaagtgtctatttctagctgaaagagtttacctcttctagacatttatgcccaatggtgtcacacatgatcatttgctcctgctctaattttaatgtgcatacaaaaaatataccaaaaatgttattgtaattttaatgagcatgtaaagagtgtatcaaaaattgatgggatattagtgttaggttttgcttaaatgaaaattaataaattcaaaaatactaaaagtcaccttctttgtcacgttagcaaccagtttctactattctgtgcccatccagtgtcaatatcattgatttctttttcatatgaagatccacatgcattgtaagattgtgaagatatataaaattgatgaattaagagaaattatgccactttcctatagtttctgtgttctgtttattgtatggtgtattcactcttggaaaatatgtaatagttgtgtatccagaatatgtgtcttcacctgaatatttaatctttatatttacaaaaaaataagttccacaagatggacaaaaatggtccatgatatttagcttaaattgtaaccttttgttgtgtatataaaacttccttggaagaaaataaccttattgttttcttaaagctaaacagaataggattggtactcattaattatgtcttgcaaatattttctaaaaattcaaccactctcctaaaatggtgtttaaatattttgtagggcagaatatgcatattgcctgttagcaagtaataattcattctcatagagaaatgggtttttacccatggaagtaatcttttttttttcttttttttttttaattttttttttaatatactttaagttttagggtacatgtgcacattgtgcaggttagttacatatatatacatgtgccatgctggtgcgctgcacccactaactcgtcatctagcattaggtatatctcccaatgctatccctccccactccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttgtatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtaatcttttaatgatattttcttattatattgctacaggcaacatcagtagaagcctatctagttacactaaactaaagatcacattcaccattcttacagccaagtggttgctggtcccctcataacttttagttacttaagttgagtaaatgtctaattgtttacaaactaaattgactaaataaggtcaaggataatgtttttcattgattaaccatttattatacatataatctattgaatataaaaagattcaccttgaaataatatttgactatataggtacatatctgtaaaagatgaccaccttaactaaatcagattttacatttataaattttatatttaattagtcaaatcaatttttaaatcataactccttaatctcataagaagcaataaatgcataaagcattatattaaaataccagggttacttatgtcattgacagggaaaagactttgtataaacaattatgcaccatctatttttgtactcttactcatgatccatttaaaagtctactcagctctagattagataccagaagaccctctaagtaactgataactgagattcgggaccatgtcttgtttgccattgtgcccttggaatttaatacaagtgcctaacccacagtagggttgattgattcactgattagttttactgccatgtgcctataactataggttattctctttccttttctatgttgtgtttattctatttattctctacaatatataaaatgtatttgttctctacaataaatgtgtttattctctacaatatataaaaacatattggactactattacataattaaattactcttt

SEQ ID NO: 110215 - DNA, 4650 bp, Homo sapiens
  Payload ID: 1629
  Gene Symbol: ABCC9
  Gene Name: ATP-binding cassette, sub-family C (CFTR/MRP), member 9
  Uniprot ID: O60706
  ENST ID: ENST00000261201
  CDS Start-End: 1-4650
atgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagccctgttcctgtattgggtaatggcctttattacaaaaacaataaaattggttaagtactgtcagtctggcttggacatatcaaacctgcgtttctgcatcacaggcatgatggtcatcttgaatgggctcttgatggctgtggagatcaatgtcattcgagtcaggagatatgtatttttcatgaatcctcagaaagtaaagcctcctgaagacctccaggatctgggagtgagatttcttcaaccatttgtgaatttgctgtcaaaagcaacatactggtggatgaacacacttattatatctgctcacaaaaagcctattgatctgaaggcaattggaaaattgccaatagcaatgagagcagtaacaaattatgtttgcctgaaagatgcatatgaagaacaaaagaaaaaagttgcagatcatccaaatcggactccatctatatggcttgcaatgtacagagcttttgggcgaccaattctacttagtagcacattccgctatctggctgatttactgggttttgctggacctctttgtatttctggaatagttcagcgtgtgaatgaaacccagaatgggacaaataacacaactggaatttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttcagccaaaaactataaacaggaaacagcctggaagatatcacctggacagctatgagcaatcaacacggcgtctacgtcccgcagaaacagaggacattgcaataaaggtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcaccgtgtctcttctattatggatgcaggccttgttttagtcttttctgagggtattttagtggagtgtgatactgtcccaaatttgctcgcccacaagaatggcctcttttccactttggtgatgaccaacaagtag

SEQ ID NO: 110216 - DNA, 1693 bp, Homo sapiens
  Payload ID: 1629
  Gene Symbol: ABCC9
  Gene Name: ATP-binding cassette, sub-family C (CFTR/MRP), member 9
  ENST ID: ENST00000326684
  CDS Start-End: 400-849
ggggaaggtctccggccccaggcgcggcgcgcggggcttctgcccagtttcctgcttctcagccgcggtgtctgccccggcccagagcagtctgtgcaatttagaaactcgataggaggcagcagctggtctcccaccaccctaaaaataatccgttccggcgcactgcgtgcttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaaggaaaagtattgtttgtgaccattgctaaatcaattatcaatgaaaggaaagaaagaaaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttaggttttagccatcatgagagtaaaagctgctatcaacattcttaagtattttgtggctatatgcatttatttctcctaggtaaatacctaagagtgaaatctctgggtcatacaataagtgggtaaatgttcatattttaagaaactgacatcttttcccaaaatgtttgtatcattttttatactcactaacaaggtgtaagagttccagttccacatgttcatcatttggtgatcttggtctaatttagtcatgctagtgggtgtgtactggtaatacattgcggttttaatttgcatttatctgattgctaattatgttgaacactctttgatgagtttattggccatttttaatctttgggatgtggctattcatatcttttgcccatgtttcattgggttgcacttttattattgcgttgtaggaatattttgtgcatactagatattagtatgtcatcagttacatgttttgataatgttttccttctagtctgtggcatacatattcatttatttaatagggtcttttaatgagcagaagattttaaatttcgatgtagtataatttatcatttcttctagtccttagttactgctttctgtgtcttaagacatctttgtcttccctctaaatatgtttccctcttattctcctgtttgcttttagatgctttatggtttccatttttatttttaggactacgattctttctaaattaattgtgtatatggtgtaagataggtgtcaaagttcttttttttttttttccaagtggatatcaatgtgttccagcaccatttgtgggatagactttctgtttctcaagagattgcattggcacttatgtaaaaaaaaataaatcaaatgactatttaaatttaa

SEQ ID NO: 110217 - DNA, 3531 bp, Homo sapiens
  Payload ID: 1629
  Gene Symbol: ABCC9
  Gene Name: ATP-binding cassette, sub-family C (CFTR/MRP), member 9
  ENST ID: ENST00000544039
  CDS Start-End: 1-3531
atttcagaaaccctctcatcaaaggaatttcttgaaaacgcttacgttctagcagttcttctcttcttggctcttattctgcaaaggacatttttgcaggcttcctactatgtaaccatagagactggcattaacctccgtggagctctgctggccatgatttataataaaatccttaggctctctacgtctaacttatccatgggggagatgactctggggcagatcaacaacttagtcgccattgaaactaatcaactcatgtggtttttgttcctgtgtcccaatctatgggctatgcctgttcagatcataatgggcgtgattctgctctataatttacttggatcaagtgcattggtcggtgcagctgtcattgtgctccttgcgccaattcagtactttattgctacaaagttggcagaggctcagaaaagtacacttgattattccactgagagactcaagaaaacaaatgaaatattgaaaggcatcaaacttctaaaattgtatgcctgggaacacattttctgcaaaagtgtggaggaaacaagaatgaaagaactatctagtctcaaaacctttgcactatatacatcactctccatcttcatgaatgcagcaattcccatagcagctgttcttgctacatttgtgacccatgcgtatgccagtggaaacaatctgaaacctgcagaggcctttgcttcactgtctctcttccatatcctggtcacaccactgttcctgctctccacggtggtcagatttgcagtcaaagccatcataagtgttcaaaagctgaatgagtttctcttgagtgatgagattggtgacgacagttggcgaactggtgaaagttcgcttccttttgagtcctgtaagaagcacactggagttgtcacaaatggatacttttcatggggcagtggtttagctacattatccaatatagatattcgaattccaacaggtcagttaaccatgattgtgggccaagtaggatgtgggaagtcctctcttctccttgccatcctcggtgagatgcagacattggaaggaaaagttcactggagcaatgtaaatgaatctgagccttcttttgaagcaaccagaagtaggaacaggtactctgtggcatatgcagctcaaaagccttggctattaaatgctacagtagaagaaaatattacttttggaagtccttttaacaaacagaggtacaaagctgtcacagatgcctgttctcttcagccagatattgacttattaccatttggagatcaaactgaaattggagagaggggcatcaacctgagtgggggacagaggcagagaatctgtgtggcacgagcgctgtatcaaaacaccaacattgtctttttggatgatccattctcagccctggacattcacttgagtgatcatttaatgcaggaggggattttgaaattcctgcaagatgacaaaaggacactcgttcttgtgactcacaaattacagtatctgacgcatgctgactggatcatagccatgaaagatggaagtgtcctaagagaaggaactttgaaggacattcaaaccaaagatgttgagctttatgaacactggaaaacacttatgaatcggcaagatcaagaattagaaaaggatatggaagctgaccaaactactttagagaggaaaactctccgacgggccatgtattcaagagaagccaaagcccagatggaggacgaagacgaagaggaagaagaggaggaagatgaggatgataacatgtccactgtaatgaggctcaggactaaaatgccatggaaaacctgctggcgctacctgacatctggaggattcttcctgctcatcctgatgattttctctaagcttttgaagcattcggtcattgtagctatagactattggctggccacatggacatcggagtacagtataaacaatactggaaaagctgatcagacctactatgtggctggctttagcatactctgtggagcaggcattttcctttgccttgttacatccctcactgtagaatggatgggtctcacagctgccaaaaatcttcaccacaaccttctcaataagataatccttggaccaataaggttttttgataccacacccctgggactgattctcaatcgcttttcagctgatactaatatcattgatcagcacatccctccaaccttggaatctctaactcgctcaacactgctctgcctgtctgccattgggatgatttcttatgctactcctgtgttcctggttgctctcctgccccttggtgttgccttttattttatccagaaatactttcgggttgcctctaaggacctccaggaacttgacgatagtacccagctccctctgctctgtcacttctcagaaacagcagaaggactcaccaccattcgggcctttaggcatgaaaccagatttaaacaacgtatgctggaactgacggatacaaacaacattgcctacttatttctctcagctgccaacagatggctggaggtcaggacggattatctgggagcttgcattgtcctcactgcatctatagcatccattagtgggtcttcgaattctggattggtaggcttgggtcttctgtatgcacttacgataaccaattatttgaattgggttgtgaggaacttggctgacctggaggtccagatgggtgcagtgaagaaggtgaacagtttcctgactatggagtcagagaactatgaaggcacaatggatccttctcaagttccagaacattggccacaagaaggggagatcaagatacatgatctgtgtgtcagatatgaaaataatctgaaacctgttcttaagcacgtcaaggcttacatcaaacctggacaaaaggtgggcatatgtggtcgcactggcagtgggaaatcatcgttatctctggctttcttcagaatggttgatatatttgatggaaaaattgtcattgatgggatagacatttccaaattaccactgcacacactacgttctagactttcaatcattctgcaggatccaatactattcagtggttccattagatttaatttagatccagagtgcaaatgcacagatgacagactctgggaagccttagaaattgctcagctgaagaatatggtcaaatctctacctggaggtctagatgcggttgtcactgaaggtggggagaattttagcgttggacagagacagctattttgccttgccagggcctttgtccgcaaaagcagcattcttattatggatgaggcaacagcttccattgacatggccacagagaatattttgcaaaaagtagtaatgacagcctttgcagaccggaccgtggtgacaatagctcaccgtgtctcttctattatggatgcaggccttgttttagtcttttctgagggtattttagtggagtgtgatactgtcccaaatttgctcgcccacaagaatggcctcttttccactttggtgatgaccaacaagtag

SEQ ID NO: 110218 - DNA, 2672 bp, Homo sapiens
  Payload ID: 1629
  Gene Symbol: ABCC9
  Gene Name: ATP-binding cassette, sub-family C (CFTR/MRP), member 9
  ENST ID: ENST00000538350
  CDS Start-End: 171-683
gtgcttcgcctaggggaggaaaactgtcatcggagagttctgcgtccgggtttgaaatttacatcttaagacagtgtaggaagtcggtgttttgaaggtagctcaagtgcaccggcaggggtttgaagcagcgtgaagctattgcccaagagtaaaccatataagaagaaatgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttagttccaggtgtttctgtctctggcttggagtccaaggacattttcccaaggttcaagcctttcactgatgctgtgggaatgccacattttactagaattactatgtagcagagtatgtttctagcataatgaaaagtatgctgtcctgaggagcagctgccattacatcacggcctttcgcacctgcattgtgactaaaattgttttattagcctctcttgcttccttgttctgtggaaatcagaggctctctaaaatattcctaattttatttttgccttgggtcaaaattatataacgcatctatatgagttatgttcaatactctgacccatcactgtattccttggagtatactttctttcttaaagagataaaggtatggaacaagaatcacagatgggctatgaacctcctgaaattgtagttcgaattatgtgtttgtgtgaatgatgcttactgtttctgattttatttgattgttgtataatgaaaatgatgttggctaatgatatagaaattaggagaagaaatattgaaaacacacacacagtattttattcatttgtccagaggacatgaaaatttaaaatggatgcatgaaagatattgattatttaattatatgttgtgtcacattatatgattgttaaaggcaatctaataaaaaaggtagagagggttaaatattaatttaaaaggctgtcacattttgaattatcttaatagaaaggtcttttgtgcaaaatgagaggcagacattattgcagaaaatgccaaaaaaagagaaagaaatttccaacaagtagctgcaaaaaaatatgtgaaattgagaatttaataagctaaatatctatttttgaaaagttgatggtaaaaagaaaggttataactagaaaggaatttagatattaataatgttttgatggaaatgcaatcagaagaggcctattattgttatttaggtgcaagacagcacaatttgatcatattgctggaaggacatggagataaaatataatatttcttgttattttaacagagaaaaatttggacctaggaaagttactcattttaagaccacaaagatagtaattttgtctcaacatttcattatgaaaatcaccaaatgtacagaaagttgaaagaatcatgtgaattcccacttacccaacatctgaattcttcaaattacattttttctgtttgttttatcacatatctacatcttttcatccttctattcatacctctctccatcttagttttgatgcattttaaggtaagttgtagacattagtatactttacctctgaacgcttcatgcgtatctttttgtgagacaaaatttatatacatgaaacacagcgatcttaatttgctaaatgcatgtacctatataacactatcatgacataactatcatccatgcaaattttcttatactcaatttcacctttacagaagcaatatctgttctgatttttacccccaccatggattaggtttgcctgttctagaacttcatgtaaattgaatgacacagtatagacttttaagtaaggcttctttttctaagcatgattttttgatgctcatccgtaatgtagcatagatcaatattttcttattgttgcatttcattgtataactatatcatagttttttcaatcccttgttaatagacatctgtactatttccaggttttagccatcatgagagtaaaagctgctatcaacattcttaagtattttgtggctatatgcatttatttctcctaggtaaatacctaagagtgaaatctctgggtcatacaataagtgggtaaatgttcatattttaagaaactgacatcttttcccaaaatgtttgtatcattttttatactcactaacaaggtgtaagagttccagttccacatgttcatcatttggtgatcttggtctaatttagtcatgctagtgggtgtgtactggtaatacattgcggttttaatttgcatttatctgattgctaattatgttgaacactctttgatgagtttattggccatttttaatctttgggatgtggctattcatatcttttgcccatgt

SEQ ID NO: 110219 - DNA, 450 bp, Homo sapiens
  Payload ID: 1629
  Gene Symbol: ABCC9
  Gene Name: ATP-binding cassette, sub-family C (CFTR/MRP), member 9
  ENST ID: ENST00000621589
  CDS Start-End: 1-450
atgagcctttcattttgtggtaacaacatttcttcatataatatcaacgatggtgtactacaaaattcctgctttgtggatgccctcaacctggtccctcatgtctttctgttgtttatcacttttccaatattgtttattgggtgggggagccaaagctcaaaagtacaaattcaccacaacacatggcttcattttccgggacataacctgagatggattcttacattcgctctcctgtttgtgcatgtctgtgaaatagcagaaggcattgtttcagactcgcggcgggaatcaaggcacctccacctctttatgccagccgtgatgggattcgttgccactacaacatcgatagtgtattatcataatatcgaaacatcaaattttcctaaattacttttaggttttagccatcatgagagtaaaagctgctatcaacattcttaa

SEQ ID NO: 110220 - DNA, 3664 bp, Homo sapiens
  Payload ID: 1630
  Gene Symbol: ABCD1
  Gene Name: ATP-binding cassette, sub-family D (ALD), member 1
  Uniprot ID: P33897
  ENST ID: ENST00000218104
  CDS Start-End: 400-2637
gccaggctgcggagcggacggacgcgcctggtgccccggggaggggcgccaccgggggaggaggaggaggagaaggtggagaggaagagacgccccctctgcccgagacctctcaaggccctgacctcaggggccagggcactgacaggacaggagagccaagttcctccacttgggctgcccgaagaggccgcgaccctggagggccctgagcccaccgcaccaggggccccagcaccaccccgggggcctaaagcgacagtctcaggggccatcgcaaggtttccagttgcctagacaacaggcccagggtcagagcaacaatccttccagccacctgcctcaactgctgccccaggcaccagccccagtccctacgcggcagccagcccaggtgacatgccggtgctctccaggccccggccctggcgggggaacacgctgaagcgcacggccgtgctcctggccctcgcggcctatggagcccacaaagtctaccccttggtgcgccagtgcctggccccggccaggggtcttcaggcgcccgccggggagcccacgcaggaggcctccggggtcgcggcggccaaagctggcatgaaccgggtattcctgcagcggctcctgtggctcctgcggctgctgttcccccgggtcctgtgccgggagacggggctgctggccctgcactcggccgccttggtgagccgcaccttcctgtcggtgtatgtggcccgcctggacggaaggctggcccgctgcatcgtccgcaaggacccgcgggcttttggctggcagctgctgcagtggctcctcatcgccctccctgctaccttcgtcaacagtgccatccgttacctggagggccaactggccctgtcgttccgcagccgtctggtggcccacgcctaccgcctctacttctcccagcagacctactaccgggtcagcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcagatgcagaggccgtgaagaaggcagccttggaaaagaaggaggaggagctggtgagcgagcgcacagaagccttcactattgcccgcaacctcctgacagcggctgcagatgccattgagcggatcatgtcgtcgtacaaggaggtgacggagctggctggctacacagcccgggtgcacgagatgttccaggtatttgaagatgttcagcgctgtcacttcaagaggcccagggagctagaggacgctcaggcggggtctgggaccataggccggtctggtgtccgtgtggagggccccctgaagatccgaggccaggtggtggatgtggaacaggggatcatctgcgagaacatccccatcgtcacgccctcaggagaggtggtggtggccagcctcaacatcagggtggaggaaggcatgcatctgctcatcacaggccccaatggctgcggcaagagctccctgttccggatcctgggtgggctctggcccacgtacggtggtgtgctctacaagcccccaccccagcgcatgttctacatcccgcagaggccctacatgtctgtgggctccctgcgtgaccaggtgatctacccggactcagtggaggacatgcaaaggaagggctactcggagcaggacctggaagccatcctggacgtcgtgcacctgcaccacatcctgcagcgggagggaggttgggaggctatgtgtgactggaaggacgtcctgtcgggtggcgagaagcagagaatcggcatggcccgcatgttctaccacaggcccaagtacgccctcctggatgaatgcaccagcgccgtgagcatcgacgtggaaggcaagatcttccaggcggccaaggacgcgggcattgccctgctctccatcacccaccggccctccctgtggaaataccacacacacttgctacagttcgatggggagggcggctggaagttcgagaagctggactcagctgcccgcctgagcctgacggaggagaagcagcggctggagcagcagctggcgggcattcccaagatgcagcggcgcctccaggagctctgccagatcctgggcgaggccgtggccccagcgcatgtgccggcacctagcccgcaaggccctggtggcctccagggtgcctccacctgacacaaccgtccccggcccctgccccgcccccaagctcggatcacatgaaggagacagcagcacccacccatgcacgcaccccgcccctgcatgcctggcccctcctcctagaaaacccttcccgccctcgggaaagtagatgtggagggtggcgccctgcgtaaccctcgccctgtccctcccactccctgggggcgctgttccacagtgactgggccctgtccagggcagtgagtcctctactttgctccgtggaggaagctggggtacaaggggcccagtgctggccacacagcagcgcagccgagccccaggagcccgtcaggccacagcccctggcactgcaggtggcctccctccagagactcgagtccccatgattccctcctcgtcagtctctcaaagaccccatggtccatcccctgagggtggtcagccaaggctcccgttccgtgggatgccataaaagccgcccagtgggacccacagtcacacagagcgcctcacctgcatcctctcccccacaagagccccaaagatcccacgggagaggggagagggacgcacagcactgcctgccaagcgagaatgcaggccccgccccctcggcccctcaccacctctttctacagcctaatttattggattccctattcgtagccatctccgtggccaatgtgactaccgtgccagcagcgggggcggcccagcctctgagtcccgtggggccccggctcccaccggtgccaaacccagcccctgcggccgtcaccccgccagcctacactgccagccgccaccggggcacacgggcctctgcttgccagccaggagtgcggacaccatgttcccagctcagtgccaaagaggggtcaccagggggagctgtctgcggagccagcgcctgcccgagagagaccccaccgccaccgtgtgcctttcccgggccctcagccctcgggccgggcaccacccccagtccccccagtaaaagcctccactggcaaatgcagtccttcctccctgc

SEQ ID NO: 110221 - DNA, 1016 bp, Homo sapiens
  Payload ID: 1630
  Gene Symbol: ABCD1
  Gene Name: ATP-binding cassette, sub-family D (ALD), member 1
  ENST ID: ENST00000370129
  CDS Start-End: 6-689
gcaacatggacgggcggcttcgcaaccctgaccagtctctgacggaggacgtggtggcctttgcggcctctgtggcccacctctactccaacctgaccaagccactcctggacgtggctgtgacttcctacaccctgcttcgggcggcccgctcccgtggagccggcacagcctggccctcggccatcgccggcctcgtggtgttcctcacggccaacgtgctgcgggccttctcgcccaagttcggggagctggtggcagaggaggcgcggcggaagggggagctgcgctacatgcactcgcgtgtggtggccaactcggaggagatcgccttctatgggggccatgaggtggagctggccctgctacagcgctcctaccaggacctggcctcgcagatcaacctcatccttctggaacgcctgtggtatgttatgctggagcagttcctcatgaagtatgtgtggagcgcctcgggcctgctcatggtggctgtccccatcatcactgccactggctactcagagtcaggtgagacccagggctccaagaggatccaggccaggggcctgtcccccataccgctgggtgctgagctcacgagggcccaactcagccagcccgccgcccacttctgctgccggggccaccgaggccctgctgccagccttgatgctttcagaggttgagctcgccttgcccctccttgttgccttttgccctgcgcgcacctcacgccctttgttaccactcagacaagcccaggactgcaagtcaggaacactacatgtcacttctccaggcacagataccctcacccacctgtccctgtcctcaacccaactgcgacttagaggtgggagaatgtgcggagtacctggagtgagccccttcatcactccagccttggtttcctcgccctgaaacagctcttgcaccctaaggtgttttagaggagtgggaagcctgttctacctgttattttagtgataagattaaatgtttaggtttctgca

SEQ ID NO: 110222 - DNA, 6238 bp, Homo sapiens
  Payload ID: 1631
  Gene Symbol: ABCD2
  Gene Name: ATP-binding cassette, sub-family D (ALD), member 2
  Uniprot ID: Q9UBJ2
  ENST ID: ENST00000308666
  CDS Start-End: 137-2359
aaaacacaacagtggaagagaaacgctgcagactatgggacgctgtaggactttctaaaacatttgctggggatttctgtgaagcatgatcttttaaaacgaattcttttggaagccggtttgggtaactgggaaaatgacacatatgctaaatgcagcagctgatcgagtgaaatggaccagatcgagtgctgctaagagggctgcctgcctggtggctgcggcatatgctctgaaaaccctctatcccatcattggcaagcgtttaaagcaatctggccacgggaagaaaaaagcagcagcttaccctgctgcagagaacacagaaatactgcattgcaccgagaccatttgtgaaaaaccttcgcctggagtgaatgcagatttcttcaaacagctactagaacttcggaaaattttgtttccaaaacttgtgaccactgaaacagggtggctctgcctgcactcagtggctctaatctcaagaacctttctttctatctatgtggctggtctggatggaaaaatcgtgaaaagcattgtggaaaagaagcctcggactttcatcatcaaattaatcaagtggcttatgattgccatccctgctaccttcgtcaacagtgcaataaggtacctggaatgcaaattggctttggccttcagaactcgcctagtagaccacgcctatgaaacctattttacaaatcagacttattataaagtgatcaatatggatgggaggctggcaaaccctgaccaatctcttacggaggatattatgatgttctcccaatctgtggctcacttgtattccaatctgaccaaacctattttagatgtaatgctgacctcctatacactcattcaaactgctacatccagaggagcaagcccaattgggcccaccctactagcaggacttgtggtgtatgccactgctaaagtgttaaaagcctgttctcccaaatttggcaaactggtggcagaggaagcacatagaaaaggctatttgcggtatgtgcactcgagaattatagccaatgtagaagaaattgccttttacagaggacataaggtagaaatgaaacaacttcagaaaagttacaaagctttagcagatcagatgaacctcattttatccaaacgtttgtggtacatcatgatagaacagttcctgatgaagtatgtttggagcagcagtggactaattatggtggctatacctattatcactgcaactggctttgcagatggtgaggatggccaaaagcaagttatggttagtgaacggacagaagcctttaccactgctcgaaatttactggcctctggagctgatgctattgaaaggattatgtcttcatacaaagaggtcactgaattagcaggctacactgctcgagtgtacaatatgttttgggtctttgatgaagtaaaaagaggcatttataagagaactgctgtcattcaagaatctgaaagccatagcaagaatggagctaaggtagaattacctctcagtgacacattggcaattaaaggaaaagttattgatgtggatcacggaattatttgtgaaaatgttcccataattacaccagcaggagaagtggtggcttccaggctaaacttcaaagtagaagaaggaatgcatcttttgataactggtcccaatggttgtgggaaaagttctctcttcagaattctaagtgggctctggcctgtgtatgaaggagtcctctataaaccacctcctcaacatatgttttatattccacaaaggccatatatgtctcttggaagtcttcgggatcaagtcatttaccctgattcagtggatgatatgcatgataaaggttatacagaccaagatctggaacgtatcctacacaatgtccatctctatcacatagttcaaagagaaggaggatgggatgctgttatggactggaaagatgtcctgtcaggaggggaaaagcaaagaatgggcatggctcgtatgttttatcataaaccaaaatatgccttgctggatgaatgtaccagtgctgtcagcattgatgtcgaaggaaagatatttcaggctgcaaaaggggctggaatttccttactgtctataacacacagaccttctctttggaaataccacacacatttattacagtttgatggtgaaggaggttggcgctttgaacaattggatactgctatccgtttgacattgagtgaagaaaaacaaaagctagaatctcagctagctggaattcccaaaatgcagcagagactcaatgaactatgtaaaattttgggagaagactcagtgctgaaaacaattaaaaatgaagatgagacatcttaatttgttttgacatattttaaaagttaattattagataaaggctcaaagacattctgttatactgcatgaagtatgttaagctaagcacagagaaaaaaaggcagcaagacatgttttataagattttagcattaaggaagtatatgatctgacttttcagaagaaaataaacaaatgcattatgtaaggtcagtcattatgacttatactaattcctagtgaaggcctaatgcacttgtaaaacaggattttctaggtgaattcatgatgaataccagatttactatgtatatgtggtgtgtctgaagttcttaacaaacatgggcaatattctggaaatgaaacaagttaaactgagcagcatttgggttgataccaagtgcataagattcaaactttgagtgacatttagtccatttatggttgatattaggtttaatagctagaattcaaattgattattgctagtggccaactaaacctgtacaaaatagctgacagttttataaataatttcaatataaaaattgttttaatggcatttgttgaaagaaaaaagcatggctaaaatgtataaaatgccatatttttaaattttggactttaagcatcttaatgagggcatataacaaattaattttagtacaaatcttaaatatttttaataaatcctttcattttaaaaagagaattgccaatacagaaaaggagtatccaaacaatgtctcaacctgataatttccttagcagaattacctattgcaacttctgttcagaaatacacagcttgtttttttgcccaaggatgagtctacattttaagaactgcaatggtataaaggaacttaaggattctgagaatcatagtaataacatacattggaatagtactttataatttacaatccccatttacatcatttcaccttaatgttgatgacaatgttttgaaacaaatactatttttcctactttgcttttgagaaaattgacactcagacttgccctaatcatgcactttacttaaggaaagatcgagaaatcaaatgaagttctcctgactctctggtttagtgctcttttgttattatcctttaaatcaaactgggctataatagcaataaaagttagacgaagtgtagaaaataaaataaatttcataatgttagtcttattgttatttggttattgtttacaagaaatgaaaattaagtacaaagtgcaaagatcattgttctgcggcttaaaatgaaatgagaaagttagtaaatcattcagcaactatgcagtcttactcaatattaatgtacctctaaggcattagcaatgagaagggcaaataattatggttttggtaaagttaatatttattgaacataatgagaaataatctatatggactagtcatatgaaatagattttattctatttgtgtgcactggagctggaaagccaagactgaaactttatctcttgctgcctgtgataccacattgacataccagaagaatattggaatgatcagttgttagtggcctaggattttatttgcctgttgagacacagccataatagatgttaagtctgtgattcttagacttttcaggtgatagagtacctggaagtcattcataatgatcgttatagaacatcataacatttctacattttcaattctgccatgatagctagtgtatttttaattttcaataaatgtaaccaacttacatgaaggaatgcaatataaaattataatcagtacatttgtccaacgttttcattagtattatcacctacttattcatcagttactaatatttcctgttagaaaagtgaggcaggaattaaagatttttttttaagaagcatggaaccaaaacttaaacttgctaaaaattattcattaatcttttctacataagtgattatccagtttatactgctacaagggcaaaagtctgaggcaagtgttttaagttaacttttaaaggtacaagaagaaaatgaaaaatcctcatgtgaaagatgtgtataattttcatgccttaattttcataatataaaaataaaacataattttaaaacaacctgataattttgttttgaaacattgaaaagaatgccaaaacaaatattagatttgtaattagtcagtatttaatatattttacccatgagctaaagcaaaaaagactcattatttatgatgcacaggattcaaagatgcctaaaattctgtattaaaaactatgtacactgtaatttaaatgttaaagttctaatatgcacatgttttccatgagctttttgtgcctatttgttttctgaatttatttttcaggaccaacatccttaacttggaagggaaaacatctctgatttgaacttgtatttatgtaccattcaattgtttccaaatggtccaatgggtataccatattttactactcttatattttacggaaaacatgaaaaagactgagaaactagccatttttgaatacagcaagggatagatgaggaaaggaaaaaagaaagaatatttcaagtttcaaactacttttaccatgttatatctatttgcccaaacgtttgacatatttttggtcaaacaaaaagctataagtttatggagcttgagtttaaaatgtgcattctttaggttaactcttaaacttgaaaaataagttggattctatgaaaacgttgcattatatttctacagcatgtaatgttatgccaagcatgagtctaaaacagtttgtgttcttgtaagcaggataatgtgtaataatccctctgaaataatctcaagaagaatgatataccttaaaactcaactcaaatttacatttgtttacagtgggaatggttttctcttgatagaaatttggtttttgtctcaagttttggtctgtcagtaaaggcataaatgaatatcctagtttttatttgaaacattggttccaagtatagtttcatatttggcaatagattcatcttattctaatatgtttggaatagctttttgattcaatgagtctaggaaaatctgttacacattgaaacccaagtccagagaatgttacacacttctaatatatgcataaaatgatggtaaaggttattaaatcattgatttaaaaagatgactttgatataattactttatgggcaaaattgtcctcatttagaagtgaaaagtactttcacatagcctaggctatttacagttctgattatatacatttagatatgttgaatatgttttggggttgaatatgttttgccacatgagcgccttcaggtggatgtataaaatatttttttaaaaaccaatttcttcttcattgttgatgcttttcctgactaccaagttcagggctggtttacatttcatattgtgaaattttcaaaaccaatggtctatttataagccagaattgtattaatgaaaatgaatgagaaaaatgtccttaaaggtaaaaatcattatgtagctaaatgaaattgtggctgtgtgtgagtacattataatataatttccatctgatgtgtatttacttgaactcatcattccttatgaattccttaaccattaagaaaaagactagattaatcaaaggaattacaaattattccatttttacaaaataccctgtttctatactgcaaatggccatgttgggtatatgtctatatacgccttacttagacattgtattgtatataaccgtgtgtagaactatagacaatagtcaccaaatagttatttaaatattaattttctttattaatacaacacatttaataagtatctacctatgccaggcactgtgctaagttctattactaaataaaatttggtccctgtccgaa

SEQ ID NO: 110223 - DNA, 884 bp, Homo sapiens
  Payload ID: 1632
  Gene Symbol: ABCD3
  Gene Name: ATP-binding cassette, sub-family D (ALD), member 3
  Uniprot ID: P28288
  ENST ID: ENST00000315713
  CDS Start-End: 1-711
atggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaaacagaagttcttaaaccatgaa

SEQ ID NO: 110224 - DNA, 3538 bp, Homo sapiens
  Payload ID: 1632
  Gene Symbol: ABCD3
  Gene Name: ATP-binding cassette, sub-family D (ALD), member 3
  Uniprot ID: P28288
  ENST ID: ENST00000370214
  CDS Start-End: 25-2004
cggctcgctggtaccggcagtgccatggcggccttcagcaagtacttgacggcgcgaaactcctcgctggctggtgccgcgttcctgctgctctgcctgctccacaagcggcgccgcgccctcggcctgcacggtaagaaaagtggaaaaccaccattacagaacaatgagaaagaggggaaaaaggagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgctttta

SEQ ID NO: 110225 - DNA, 3003 bp, Homo sapiens
  Payload ID: 1633
  Gene Symbol: ABCD4
  Gene Name: ATP-binding cassette, sub-family D (ALD), member 4
  Uniprot ID: O14678
  ENST ID: ENST00000356924
  CDS Start-End: 145-1965
cgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaagaattacagctttctgtcttctctatcatggaatgatcttttttattgaatctccagatttgtatttgacagcttggtgggaagggaagcacactctgctgttctggaatcttatgcccagggtttttcacttctccccacatctccctttccacttgccagtgttgtgtagttagaacctgaaccactaacttccaggggcctttggtctgccctaccttaacccaaatgaaagtaaatccctttccccttagccaaaataaggttgggttttctaaaaaaatagtctatattagggaacaacaacagcaaattagacaaaacccagaaagcacaaagcatgaggtggagttactgtgcccaaagtcctcactcagaccagtgcccctccagttcagttgtctatgtattaccttccttaccttcataatttttgccaggcttctgtacttctagtacttgagttacttaatatttttaaaaacaaaccttttaagtttaaatggatttttaagtgaaattttacacttaacatagatggaaagtaactaaaaataaatacaagaaaaacca

SEQ ID NO: 110226 - DNA, 794 bp, Homo sapiens
  Payload ID: 1633
  Gene Symbol: ABCD4
  Gene Name: ATP-binding cassette, sub-family D (ALD), member 4
  ENST ID: ENST00000474270
  CDS Start-End: 1-520
cgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagc

SEQ ID NO: 110227 - DNA, 853 bp, Homo sapiens
  Payload ID: 1633
  Gene Symbol: ABCD4
  Gene Name: ATP-binding cassette, sub-family D (ALD), member 4
  ENST ID: ENST00000470637
  CDS Start-End: 48-218
actgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccgtaggcgccccaactcagtcctttctacactctgtgtggtcctttccttctggcctagccctggagactgctggtggcagacaccaaggagatcatctgcagtcgttttcaaatgctgctgcccagagtcatgggggagggtgccctgcagaggactcctggagaagctgcagggctgtgaataggcagctaaaaagaagaagcctgccaggtgcagtggcatgcacctgtagtcccaacaactcaggaggctgaggcaggaggatcacttgagcccaggagtagtgcaccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatc

SEQ ID NO: 110228 - DNA, 966 bp, Homo sapiens
  Payload ID: 1633
  Gene Symbol: ABCD4
  Gene Name: ATP-binding cassette, sub-family D (ALD), member 4
  ENST ID: ENST00000469672
  CDS Start-End: 81-200
cggggccccgcccctcctcggactctacccagtactgaactaggggcagctgggctccagagtccctcgggtctcaggtcatggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagtcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagg

SEQ ID NO: 110229 - DNA, 1177 bp, Homo sapiens
  Payload ID: 1633
  Gene Symbol: ABCD4
  Gene Name: ATP-binding cassette, sub-family D (ALD), member 4
  ENST ID: ENST00000481348
  CDS Start-End: 1-554
ttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacagtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaagaaaagttaaacattaaaaa

SEQ ID NO: 110230 - DNA, 1003 bp, Homo sapiens
  Payload ID: 1633
  Gene Symbol: ABCD4
  Gene Name: ATP-binding cassette, sub-family D (ALD), member 4
  ENST ID: ENST00000460308
  CDS Start-End: 144-314
gcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagtcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgc

SEQ ID NO: 110231 - DNA, 2336 bp, Homo sapiens
  Payload ID: 1633
  Gene Symbol: ABCD4
  Gene Name: ATP-binding cassette, sub-family D (ALD), member 4
  ENST ID: ENST00000481935
  CDS Start-End: 26-196
tccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttaactttaactgaccatttaagttttttaataagttttttacaaaga

SEQ ID NO: 110232 - DNA, 838 bp, Homo sapiens
  Payload ID: 1633
  Gene Symbol: ABCD4
  Gene Name: ATP-binding cassette, sub-family D (ALD), member 4
  ENST ID: ENST00000556119
  CDS Start-End: 5-124
ggtcatggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgg

SEQ ID NO: 110233 - DNA, 1842 bp, Homo sapiens
  Payload ID: 1633
  Gene Symbol: ABCD4
  Gene Name: ATP-binding cassette, sub-family D (ALD), member 4
  ENST ID: ENST00000553486
  CDS Start-End: 34-204
agctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcagga

SEQ ID NO: 110234 - DNA, 947 bp, Homo sapiens
  Payload ID: 1633
  Gene Symbol: ABCD4
  Gene Name: ATP-binding cassette, sub-family D (ALD), member 4
  ENST ID: ENST00000556517
  CDS Start-End: 1-554
ttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctggtaagtggggagagggaccctcaggacccgagcccacctgggagcaccagctacagtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggccagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccagga

SEQ ID NO: 110235 - DNA, 582 bp, Homo sapiens
  Payload ID: 1633
  Gene Symbol: ABCD4
  Gene Name: ATP-binding cassette, sub-family D (ALD), member 4
  ENST ID: ENST00000555904
  CDS Start-End: 1-476
caggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaagggcagcctgatctccatgtggtggtggtctcttgtagtttcattccttggttctgaaactctgtggaggaggaagatgggagctgatgagaatcaaagtggaatgaagctctggcttttggaaggagagccacactgtggcgggtcggcggccctcaggagagaccaggaggactgacagcgaagatcgagctcaggttcgccacatagatcccgtgcaggagccacatgggtcctgtgcaggacccctagcagtggtgggctgagcccaggtctaggtttct

SEQ ID NO: 110236 - DNA, 736 bp, Homo sapiens
  Payload ID: 1633
  Gene Symbol: ABCD4
  Gene Name: ATP-binding cassette, sub-family D (ALD), member 4
  ENST ID: ENST00000554453
  CDS Start-End: 7-303
caggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacaggcggccccccaacctggctgaacctctccagccctgtggacatcccagcctttccttgtcagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaag

SEQ ID NO: 110237 - DNA, 542 bp, Homo sapiens
  Payload ID: 1633
  Gene Symbol: ABCD4
  Gene Name: ATP-binding cassette, sub-family D (ALD), member 4
  ENST ID: ENST00000555617
  CDS Start-End: 48-167
actgaactaggggcagctgggctccagagtccctcgggtctcaggtcatggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgggaccagcgcatcagccaggacgtggagcgattctgccggcagctcagcagcatggccagcaagctcatcatctccccgttcaccctcgtctactacacttaccagtgcttccaaaggttcaagcacatgcagattcgggtgaatgcggagcctgctgctttctacagtcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacc

SEQ ID NO: 110238 - DNA, 637 bp, Homo sapiens
  Payload ID: 1633
  Gene Symbol: ABCD4
  Gene Name: ATP-binding cassette, sub-family D (ALD), member 4
  ENST ID: ENST00000556971
  CDS Start-End: 1-617
ggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttaggttcaagcacatgcagattcgggtgaatgcggagcctgctgctttctacagtcggcatcaacacctttgactatctgggcagcatcctga

SEQ ID NO: 110239 - DNA, 1770 bp, Homo sapiens
  Payload ID: 1633
  Gene Symbol: ABCD4
  Gene Name: ATP-binding cassette, sub-family D (ALD), member 4
  ENST ID: ENST00000553745
  CDS Start-End: 58-177
tctacccagtactgaactaggggcagctgggctccagagtccctcgggtctcaggtcatggcggtcgcggggcccgcgcccggagctggcgccagagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaagcacaggctggctcgggcctgtgagcatcttcgggtatttcatcctggggaccgtggtgaacaaaactttgatgggccccattgtgatgaagctggtgcatcaggagaagctggagggagattttagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacagaattgggcagcttcgggagacgcttctggacatgtccctgaagtcacaggactgcgagatcctgggcgagagcgagtggggcttggacacacccccagggtggccagcggcagagccagcagacacagcatttctccttgagcgggtctccatctctgccccctcctctgacaaacccctaatcaaggatctgagcctaaagatctccgagggacagagcctgctcatcacaggcaacacgggcactggcaagacctccttgctccgggttctgggtggcctctggacgagtacacggggctcagtgcagatgctgacggactttgggccccatggggtgctattcctgccacaaaagccattcttcactgacgggacccttcgggagcaggtgatatatcccctgaaggaggtctaccccgactcaggttctgccgatgatgagaggatcttgaggttcttggaattggcaggcctgtccaacttggtggcaaggacagagggcctggaccagcaggtggactggaactggtatgatgttctgtccccgggggagatgcaacggctctcctttgcccgactcttctacctgcagccgaagtacgcagtgcttgatgaagccaccagtgccctgacagaggaagtggagagcgagctctatcgcatcggccagcagctggggatgacgttcatcagtgtgggacatcggcagagccttgagaaggtacccgtgctcacaaggatggcctgaggaggagaaagaacccaaaggctcagcctggccagggccagaggcccctcaaaacggggagtagcagtagcagagagaaccgagtggcctcctctgccagcggc

SEQ ID NO: 110240 - DNA, 763 bp, Homo sapiens
  Payload ID: 1633
  Gene Symbol: ABCD4
  Gene Name: ATP-binding cassette, sub-family D (ALD), member 4
  ENST ID: ENST00000557588
  CDS Start-End: 76-687
ccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttcttggtcatcacaaaatgccttgatgttcctgacccttttgtgcctgaccctactggagcaatttgtgatctaccaggttggcttgatccccagtcagtactatggggtcctgggaaacaaagacttggaagggtttaagactctgacattcctggctgtcatgctcattgttctgaactccacgctgaagagctttgatcagttcacctgcaacctgctgtatgtgagctggaggaaggacctcactgagcaccttcaccgcctctacttccggggccgtgcgtactacaccctcaacgtgctgcgggatgacatcgataacccggaccagcgcatcagccaggacgtggagcgattctgccggcagctcagcagcatggccagcaagctcatcatctccccgttcaccctcgtctactacacttaccagtgcttccaaaggttcaagcacatgcagattcgggtgaatgcggagcctgctgctttctacagtcggcatcaacacctttgactatctgggcagcatcctgagttacgttgtcatcgcaatccccattttcagcggggtctatggagacctgagtccc

SEQ ID NO: 110241 - DNA, 478 bp, Homo sapiens
  Payload ID: 1633
  Gene Symbol: ABCD4
  Gene Name: ATP-binding cassette, sub-family D (ALD), member 4
  ENST ID: ENST00000553998
  CDS Start-End: 1-283
catcctggggaccgtggtgaacaaaactttgatgggccccattgtgatgaagctggtgcatcaggagaagctggagggagattttaggttcaagcacatgcagattcgggtgaatgcggagcctgctgctttctacagccctgtggacatcccagcctttccttgtcagagctgggcatgtggagcacatgaggacagaccgcaggctgcagagactccttcagacccagagggagctgatgtccaaggagctctggctgtacatcggcatcaacacctttgactatctgggcagcatcctgagttacgttgtcatcgcaatccccattttcagcggggtctatggagacctgagtcccgcagagcttagcaccctggtcagcaagaatgcctttgtgtgcatctacctcatcagctgcttcacccagctcatcgacctgtccacgacgctctcagatgtggctggctacacgcacag

SEQ ID NO: 110242 - DNA, 3921 bp, Homo sapiens
  Payload ID: 1634
  Gene Symbol: ABCE1
  Gene Name: ATP-binding cassette, sub-family E (OABP), member 1
  Uniprot ID: P61221
  ENST ID: ENST00000296577
  CDS Start-End: 516-2315
aagccgtgtcggcaccagactctgttggtcctactgacacctccagcgttagaatgactaaggctccactcctgacccaccggccttgaggaaagcgcaaacgtaaaaaaagattgaaaccggagaggcgaatgcatctgtttacgctaggaccacgctcgacgtcggagaaaagcccacacactcacagtttccagacctggctgcttgccgaaactcagattctcggcacctccagcagctggcttcgccaacggcgttgaacaagggtcgcagctcaatgacgtcatatctccctacctacctccagggttccgcctcacgctctatgtcgcgcgcgcgcactacgtcctatggcttgcgcgtgcggcggctgggcaccgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaactggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctg

SEQ ID NO: 110243 - DNA, 786 bp, Homo sapiens
  Payload ID: 1634
  Gene Symbol: ABCE1
  Gene Name: ATP-binding cassette, sub-family E (OABP), member 1
  ENST ID: ENST00000502586
  CDS Start-End: 157-786
gcttgcgcgtgcggcggctgggcaccgccattttggccggtggccgtgagaacacgctgtgtggctgaaaagtgaaggcaagagctgatttggcctctgtgctcccctccgcaaggggatcgttttctccagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaa

SEQ ID NO: 110244 - DNA, 2146 bp, Homo sapiens
  Payload ID: 1634
  Gene Symbol: ABCE1
  Gene Name: ATP-binding cassette, sub-family E (OABP), member 1
  ENST ID: ENST00000507193
  CDS Start-End: 137-1402
accgccattttggccggtggccgtgagaacacgctgtgtggctgaaaagtgaaggcaagagctgatttggcctctgtgctcccctccgcaaggggatcgttttctccagaagagctggatattctttcgcccagttatggcagacaagttaacgagaattgctattgtcaaccatgacaaatgtaaacctaagaaatgtcgacaggaatgcaaaaagagttgtcctgtagttcgaatgggaaaattatgcatagaggttacaccccagagcaaaatagcatggatttccgaaactctttgtattggttgtggtatctgtattaagaaatgcccctttggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgatttaacccacctaaaagaacgaaatgttgaagatctttcaggaggagagttgcagagatttgcttgtgctgtcgtttgcatacagaaagctgatattttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggaacgggtaaaacgacatttatcagaatgcttgctggaagacttaaacctgatgaaggaggagaagtaccagttctaaatgtcagttataagccacagaaaattagtcccaaatcaacttagctcacgcctgtaatgccaacacttcgggaggcctaggccagcagatcacgaggtcaggagatcgagaccatcctggctaacatggtgaaaccctgtctctactaaaactacaaaaaactagccgagcgtggtggcagcgcctgtagtcccagctactcaggaggctgaggcaggagaatggcgtgaacctgggaggcagagcttgcaggaagtgttcgccagttactacatgaaaagataagagatgcttatactcacccacaatttgtgaccgatgtaatgaagcctctgcaaattgaaaacatcattgatcaagaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacgtttcatactccatgcaaaaaagacagcctttgttgtggaacatgacttcatcatggccacctatctagcggatcgcgtcatcgtttttgatggtgttccatctaagaacacagttgcaaacagtcctcaaacccttttggctggcatgaataaatttttgtctcagcttgaaattacattcagaagagatccaaacaactataggccacgaataaacaaacttaattcaattaaggatgtagaacaaaagaagagtggaaactactttttcttggatgattag

SEQ ID NO: 110245 - DNA, 625 bp, Homo sapiens
  Payload ID: 1634
  Gene Symbol: ABCE1
  Gene Name: ATP-binding cassette, sub-family E (OABP), member 1
  ENST ID: ENST00000504292
  CDS Start-End: 1-444
ggcgccttatcaattgtcaatctaccaagcaacttggaaaaagaaaccacacatcgatattgtgccaatgccttcaaacttcacaggttgcctatccctcgtccaggtgaagttttgggattagttggaactaatggtattggaaagtcaactgctttaaaaattttagcaggaaaacaaaagccaaaccttggaaagtacgatgatcctcctgactggcaggagattttgacttatttccgtggatctgaattacaaaattactttacaaagattctagaagatgacctaaaagccatcatcaaacctcaatatgtagaccagattcctaaggctgcaaaggggacagtgggatctattttggaccgaaaagatgaaacaaagacacaggcaattgtatgtcagcagcttgtttcatgtttgatgagccttctagttacctagatgtcaagcagcgtttaaaggctgctattactatacgatctctaataaatccagatagatatatcattgtggtggaacatgatctaagtgtattagactatctctccgacttcatctgctgtttatatggtgtaccaagcgcctatggagttgtcactatgccttttagtgtaagagaagg

SEQ ID NO: 110246 - DNA, 3481 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000326195
  CDS Start-End: 113-2650
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaa

SEQ ID NO: 110247 - DNA, 3131 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000376545
  CDS Start-End: 96-2519
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgac

SEQ ID NO: 110248 - DNA, 3250 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000383587
  CDS Start-End: 96-2519
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110249 - DNA, 3381 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000383588
  CDS Start-End: 113-2650
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110250 - DNA, 1484 bp, Homo sapiens
  Payload ID: 1635
  Gene Symbol: ABCF1
  Gene Name: ATP-binding cassette, sub-family F (GCN20), member 1
  ENST ID: ENST00000400609
  CDS Start-End: 37-753
ccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcacggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgaagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110251 - DNA, 3381 bp, Homo sapiens; identical to SEQ ID NO: 110249
  Payload ID: 1635
  Gene Symbol: ABCF1
  Gene Name: ATP-binding cassette, sub-family F (GCN20), member 1
  Uniprot ID: Q8NE71
  ENST ID: ENST00000419893
  CDS Start-End: 113-2650

SEQ ID NO: 110252 - DNA, 3250 bp, Homo sapiens; identical to SEQ ID NO: 110248
  Payload ID: 1635
  Gene Symbol: ABCF1
  Gene Name: ATP-binding cassette, sub-family F (GCN20), member 1
  Uniprot ID: Q8NE71
  ENST ID: ENST00000452530
  CDS Start-End: 96-2519

SEQ ID NO: 110253 - DNA, 1483 bp, Homo sapiens
  Payload ID: 1635
  Gene Symbol: ABCF1
  Gene Name: ATP-binding cassette, sub-family F (GCN20), member 1
  ENST ID: ENST00000454094
  CDS Start-End: 37-753
ccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcacggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110254 - DNA, 3250 bp, Homo sapiens; identical to SEQ ID NO: 110248
  Payload ID: 1635
  Gene Symbol: ABCF1
  Gene Name: ATP-binding cassette, sub-family F (GCN20), member 1
  Uniprot ID: Q8NE71
  ENST ID: ENST00000420257
  CDS Start-End: 96-2519

SEQ ID NO: 110255 - DNA, 3249 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000421042
  CDS Start-End: 96-2519
gcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110256 - DNA, 1484 bp, Homo sapiens; identical to SEQ ID NO: 110250
  Payload ID: 1635
  Gene Symbol: ABCF1
  Gene Name: ATP-binding cassette, sub-family F (GCN20), member 1
  ENST ID: ENST00000416932
  CDS Start-End: 37-753

SEQ ID NO: 110257 - DNA, 1074 bp, Homo sapiens
  Payload ID: 1635
  Gene Symbol: ABCF1
  Gene Name: ATP-binding cassette, sub-family F (GCN20), member 1
  ENST ID: ENST00000426591
  CDS Start-End: 56-1074
gccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatgg

SEQ ID NO: 110258 - DNA, 1483 bp, Homo sapiens; identical to SEQ ID NO: 110253
  Payload ID: 1635
  Gene Symbol: ABCF1
  Gene Name: ATP-binding cassette, sub-family F (GCN20), member 1
  ENST ID: ENST00000421608
  CDS Start-End: 37-753

SEQ ID NO: 110259 - DNA, 1484 bp, Homo sapiens; identical to SEQ ID NO: 110250
  Payload ID: 1635
  Gene Symbol: ABCF1
  Gene Name: ATP-binding cassette, sub-family F (GCN20), member 1
  ENST ID: ENST00000456791
  CDS Start-End: 37-753

SEQ ID NO: 110260 - DNA, 1484 bp, Homo sapiens; identical to SEQ ID NO: 110250
  Payload ID: 1635
  Gene Symbol: ABCF1
  Gene Name: ATP-binding cassette, sub-family F (GCN20), member 1
  ENST ID: ENST00000457970
  CDS Start-End: 37-753

SEQ ID NO: 110261 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000418552
  CDS Start-End: 56-1074

SEQ ID NO: 110262 - DNA, 3250 bp, Homo sapiens; identical to SEQ ID NO: 110248
  Payload ID: 1635
  Gene Symbol: ABCF1
  Gene Name: ATP-binding cassette, sub-family F (GCN20), member 1
  Uniprot ID: Q8NE71
  ENST ID: ENST00000448939
  CDS Start-End: 96-2519

SEQ ID NO: 110263 - DNA, 3249 bp, Homo sapiens; identical to SEQ ID NO: 110255
  Payload ID: 1635
  Gene Symbol: ABCF1
  Gene Name: ATP-binding cassette, sub-family F (GCN20), member 1
  Uniprot ID: Q8NE71
  ENST ID: ENST00000412443
  CDS Start-End: 96-2519

SEQ ID NO: 110264 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000441867
  CDS Start-End: 56-1074

SEQ ID NO: 110265 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000441688
  CDS Start-End: 56-1074

SEQ ID NO: 110266 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000424994
  CDS Start-End: 56-1074

SEQ ID NO: 110267 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000429395
  CDS Start-End: 56-1074

SEQ ID NO: 110268 - DNA, 3381 bp, Homo sapiens; identical to SEQ ID NO: 110249
  Payload ID: 1635
  Gene Symbol: ABCF1
  Gene Name: ATP-binding cassette, sub-family F (GCN20), member 1
  Uniprot ID: Q8NE71
  ENST ID: ENST00000423247
  CDS Start-End: 113-2650

SEQ ID NO: 110269 - DNA, 3380 bp, Homo sapiens
  Payload ID: 1635
  Gene Symbol: ABCF1
  Gene Name: ATP-binding cassette, sub-family F (GCN20), member 1
  Uniprot ID: Q8NE71
  ENST ID: ENST00000457078
  CDS Start-End: 113-2650
cgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcagacaaagtggtgaagaaagggaagaaggacaagaagatcaaaaaaacgttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggataaagaagaagaaattataaaggaaaaggagcctcccaaacaagggaaggagaaggccaagaaggcagagcagggttcagaggaagaaggagaaggggaagaagaggaggaggaaggaggagagtctaaggcagatgatccctatgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgca

SEQ ID NO: 110270 - DNA, 3381 bp, Homo sapiens; identical to SEQ ID NO: 110249
  Payload ID: 1635
  Gene Symbol: ABCF1
  Gene Name: ATP-binding cassette, sub-family F (GCN20), member 1
  Uniprot ID: Q8NE71
  ENST ID: ENST00000457111
  CDS Start-End: 113-2650

SEQ ID NO: 110271 - DNA, 3380 bp, Homo sapiens; identical to SEQ ID NO: 110269
  Payload ID: 1635
  Gene Symbol: ABCF1
  Gene Name: ATP-binding cassette, sub-family F (GCN20), member 1
  Uniprot ID: Q8NE71
  ENST ID: ENST00000426219
  CDS Start-End: 113-2650

SEQ ID NO: 110272 - DNA, 1074 bp, Homo sapiens; identical to SEQ ID NO: 110257
  Payload ID: 1635
  Gene Symbol: ABCF1
  Gene Name: ATP-binding cassette, sub-family F (GCN20), member 1
  ENST ID: ENST00000423030
  CDS Start-End: 56-1074

SEQ ID NO: 110273 - DNA, 606 bp, Homo sapiens
  Payload ID: 1635
  Gene Symbol: ABCF1
  Gene Name: ATP-binding cassette, sub-family F (GCN20), member 1
  ENST ID: ENST00000468958
  CDS Start-End: 291-606
ggaaatagcaccgggcgccgccacagtagctgtaactgccaccgcgatgccgaaggcgcccaagcagcagccgccggagcccgagtggatcggggacggagagagcacgagcccatcagttctttgaagagctggcagtagaagataaacaggctggggaagaagagaaagtgctcaaggagaaggagcagcagcagcagcaacagcaacagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaagtacccgccccaaaaccccgcggagggaagaaaaccaagggtggtaatgtttttgcagccctgattcaggatcagagtgaggaagaggaggaggaagaaaaacatcctcctaagcctgccaagccggagaagaatcggatcaataaggccgtatctgaggaacagcagcctgcactcaagggcaaaaagggaaaggaagagaagtcaaaagggaaggctaagcctcaaaataaattcgctgctctggacaatgaagaggaggata

SEQ ID NO: 110274 - DNA, 2860 bp, Homo sapiens
  Payload ID: 1635
  Gene Symbol: ABCF1
  Gene Name: ATP-binding cassette, sub-family F (GCN20), member 1
  ENST ID: ENST00000475993
  CDS Start-End: 1-1789
tgctcatcttagcaaaaaggagaagaaaaagctgaaaaaacagatggagtatgagcgccaagtggcttcattaaaagcagccaatgcagctgaaaatgacttctccgtgtcccaggcggagatgtcctcccgccaagccatgttagaaaatgcatctgacatcaagctggagaagttcagcatctccgctcatggcaaggagctgttcgtcaatgcagacctgtacattgtagccggccgccgctacgggctggtaggacccaatggcaagggcaagaccacactcctcaagcacattgccaaccgagccctgagcatccctcccaacattgatgtgttgctgtgtgagcaggaggtggtagcagatgagacaccagcagtccaggctgttcttcgagctgacaccaagcgattgaagctgctggaagaggagcggcggcttcagggacagctggaacaaggggatgacacagctgctgagaggctagagaaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccagggcactgttcatggagcccacactgctgatgctggatgagcccaccaaccacctggacctcaacgctgtcatctggcttaataactacctccagggctggcggaagaccttgctgatcgtctcccatgaccagggcttcttggatgatgtctgcactgatatcatccacctcgatgcccagcggctccactactataggggcaattacatgaccttcaaaaagatgtaccagcagaagcagaaagaactgctgaaacagtatgagaagcaagagaaaaagctgaaggagctgaaggcaggcgggaagtccaccaagcaggcggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgtgacattcggctaccagggacagaaaccactctttaagaacttggattttggcatcgacatggattcaaggatttgcattgtgggccctaatggtgtggggaagagtacgctactcctgctgctgactggcaagctgacaccgacccatggggaaatgagaaagaaccaccggctgaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtggtcagaaggcgcgagttgtgtttgctgagctggcctgtcgggaacctgatgtcctcatcttggacgagccaaccaataacctggacatagagtctattgatgctctaggggaggccatcaatgaatacaagggtgctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggagacggagtcttgctctgtcgccatcctggaatgcagtagcgttatctcggctcactgcaacctctgcctcctggattcaagcgattcccctgcctcagcctcccaagtagctgggactacaggtgcgtgccaccactcccggctaatttttttttttttttgagacagagtcttgctctgtcgcccaggctggagtgcagtggcgcgatctctgctcgctgcaagctccacctcccgggttcatgccattctcctgcctcagtctcctcagtagctgggattacaggcacccgccaccacacccacctaagtttttgtatttttagtagagaaggggtttcaccttgttagccaggatggtctccatctcctgacctcatgatctgcccgcttcggcctcccaaagtgctgggattacaggcgtgagccaccgcgcctggcaatttttgtatttttaatagagacggggtttcaccatgttggctaggatggtctccatctcctgaccttgggatttgcccgcctcggcctcccagagtgttgggattacaggtgtgagccaccgcgctcggccgagcttattcttaaaatacagtaaaaactttaagctct

SEQ ID NO: 110275 - DNA, 2185 bp, Homo sapiens
  Payload ID: 1636
  Gene Symbol: ABCF2
  Gene Name: ATP-binding cassette, sub-family F (GCN20), member 2
  Uniprot ID: Q9UG63
  ENST ID: ENST00000222388
  CDS Start-End: 47-1951
cccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtacgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgcaccctgacattggcatctctgccaaggccatgagcatcatgaactcgtttgtaaacgacgtgtttgagcagctggcgtgtgaggctgcccggctggcccagtactcgggccggaccaccctgacatcccgagaagtccagacggctgtgcgtctgctgctgcctggggagctggccaagcacgctgtgtctgagggcaccaaggctgtcaccaagtacaccagctccaagtgacccagggcctgacaaaaataaagggtgaactgtt

SEQ ID NO: 110276 - DNA, 3546 bp, Homo sapiens
  Payload ID: 1636
  Gene Symbol: ABCF2
  Gene Name: ATP-binding cassette, sub-family F (GCN20), member 2
  Uniprot ID: Q9UG63
  ENST ID: ENST00000287844
  CDS Start-End: 111-1982
gagccggccgcacgcggaggatcctaaggagcagctctgttgcgacataggccgagcagcgaggcccagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttctgaatggtgtctgtaccaatatcattcacatgcacaacaagaaactgaagtattatacgggtaattatgatcagtacgtgaagacgcggctagagctggaggagaaccagatgaagaggtttcactgggagcaagatcagattgcacacatgaagaactacattgcgaggtttggtcatggcagtgccaagctggcccggcaggcccagagcaaggagaagacgctacagaaaatgatggcatcaggactgacagagagggtcgtgagcgataagacactgtcattttatttcccaccatgtggcaagatccctccacctgtcattatggtgcaaaatgtgagcttcaagtatacaaaagatgggccttgcatctacaataatctagaatttggaattgaccttgacacacgagtggctctggtagggcccaatggagcagggaagtcaactcttctgaagctgctaactggagagctactacccacagatggcatgatccgaaaacactctcatgtcaagatagggcgttaccatcagcatttacaagagcagctggacttagatctctcacctttggagtacatgatgaagtgctacccagagatcaaggagaaggaagaaatgaggaagatcattgggcgatacggtctcactgggaaacaacaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttagacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattcacagactttaacatgaatcagaatcacctggagggctcatgcaatcagattgccagatctcgcctcagcgtttctggttcaataggttttgggggagaccaagaacgttaacatttctagcaagtttccaggtgatgctgttgttgctggtctagagactattttgagaaccactgtccaggagcgtggttttctgattgtgatctgaggttctgccccaactgcacagcagttgggctgcttgttaaaaatgcaggccaggtgcggtggctcacacctgtaatcccagcgctttgggaggctgaggcaggtggatcacttgagctcaggagttcaagaccagcttgggaaacatggcaaaacccgtctttatgtgcctggaatcccacctgctcaggtggctagggtggatggatcgcttgagcccaggaggtggaggttgcagtgagctgagattgcaccactgcattccagcctggatgacagagcaaaaccctgtctcaaaaaaatgcagactggccaggcacagtggctcacacctgtaatccgactgtaagctcatcaccttgggaggccactgtaggaggatcaattgagcctagaagttcaagaccagcctgggcaaagtagggagaccccttctctacaaatagtaataaaatgaaccgggcatagtagcatgtgcctgcggtcccagctgctctgataagaggaggctcacttgagcccaggaggttgaggctgcagtgagcagagcgtgccgctacactccagcctgatgacagaccgagacactgtctcaaaaaaataaaaaaattcagattgctga

SEQ ID NO: 110277 - DNA, 941 bp, Homo sapiens
  Payload ID: 1636
  Gene Symbol: ABCF2
  Gene Name: ATP-binding cassette, sub-family F (GCN20), member 2
  ENST ID: ENST00000441774
  CDS Start-End: 222-941
gagaagctgacgggcggggtgggggaggacccgggggtgacgagcgtggagactcggaggggactcacgcgggcgaggacgagtgcgtcccggcaagaggctgggctcgacggccgggtgatgtggagagggacgatcgagaagaggcccgagacggacgggaggaggaagcccggaaagctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgcc

SEQ ID NO: 110278 - DNA, 1031 bp, Homo sapiens
  Payload ID: 1636
  Gene Symbol: ABCF2
  Gene Name: ATP-binding cassette, sub-family F (GCN20), member 2
  ENST ID: ENST00000468073
  CDS Start-End: 169-1031
gcgggggcaggccagggcatcagaggcttgatgttgatacgaagattcctgagagggatggagcagggcccaggcattcttactagtaagtttagggtttgggggtatctgtttgccttccttcaggctccctgaaacaacagtaacctacccctgtgggtcatcatcatgccctccgacctggccaagaagaaggcagccaaaaagaaggaggctgccaaagctcgacagcggcccagaaaaggacatgaagaaaatggagatgttgtcacagaaccacaggtggcagagaagaatgaggccaatggcagagagaccacagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatgcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccagagccctctttattcggcccttcatgctgctcctggatgagcctaccaaccacctggacctagatgcttgcgtgtggttggaagaagaactaaaaacttttaagcgcatcttggtcctcgtctcccattcccaggattttct

SEQ ID NO: 110279 - DNA, 2453 bp, Homo sapiens
  Payload ID: 1637
  Gene Symbol: ABCF3
  Gene Name: ATP-binding cassette, sub-family F (GCN20), member 3
  Uniprot ID: Q9NUQ8
  ENST ID: ENST00000292808
  CDS Start-End: 35-2146
acagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 110280 - DNA, 2624 bp, Homo sapiens
  Payload ID: 1637
  Gene Symbol: ABCF3
  Gene Name: ATP-binding cassette, sub-family F (GCN20), member 3
  Uniprot ID: Q9NUQ8
  ENST ID: ENST00000429586
  CDS Start-End: 186-2315
agactcggcgcctctcctcaaggccccgctcgccccgcccaccgggctctgcgcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctc

SEQ ID NO: 110281 - DNA, 690 bp, Homo sapiens
  Payload ID: 1637
  Gene Symbol: ABCF3
  Gene Name: ATP-binding cassette, sub-family F (GCN20), member 3
  ENST ID: ENST00000421340
  CDS Start-End: 114-425
gtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgggagaaggtgactgcttttcttatcgcttacagactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgaga

SEQ ID NO: 110282 - DNA, 2923 bp, Homo sapiens
  Payload ID: 1638
  Gene Symbol: ABCG1
  Gene Name: ATP-binding cassette, sub-family G (WHITE), member 1
  Uniprot ID: P45844
  ENST ID: ENST00000347800
  CDS Start-End: 80-2071
gctttataaaggggagtttccctgcacaagctctctctcttgtctgccgccatgtgagacatgcctttcaccttccgccatgatcatgaggcttccccagccacatggaactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110283 - DNA, 3037 bp, Homo sapiens
  Payload ID: 1638
  Gene Symbol: ABCG1
  Gene Name: ATP-binding cassette, sub-family G (WHITE), member 1
  Uniprot ID: P45844
  ENST ID: ENST00000343687
  CDS Start-End: 152-2185
agcctgcgactgcactcccggggacaccctctcccggacccactcggggaggcggcggcgaaggcccggggagacccgcgaggggcaagcccggattcctgccggccgcctttctgcgcgcgccggagagagagacgcggtggggacagggatgcgcatttcacttccccgagctccggagagggatggcggggtgtcggcgagttcactgctggacacagttactaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110284 - DNA, 3034 bp, Homo sapiens
  Payload ID: 1638
  Gene Symbol: ABCG1
  Gene Name: ATP-binding cassette, sub-family G (WHITE), member 1
  Uniprot ID: P45844
  ENST ID: ENST00000361802
  CDS Start-End: 146-2182
gagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110285 - DNA, 3475 bp, Homo sapiens
  Payload ID: 1638
  Gene Symbol: ABCG1
  Gene Name: ATP-binding cassette, sub-family G (WHITE), member 1
  ENST ID: ENST00000398437
  CDS Start-End: 149-2623
ttctttccaagggtctctgggtgaggcccgtgaccttcccaagcctctccctgtcttgtgaaacctgggcgtgatatacctcccttttagggctgctgcgatcatttaggcagattaaacctcataagtggtttcccatacaagaaagatgctagcagtgcaacagacagaacacttacctgcctgccctcccgccaggaggtggtcttccaacttttgcccggagtctacagagggtgggccctctctgctggggctccgggacatggtcaggagaggttggtctgtctgtaccgccattctcttggccagactgtggtgtctggtccctactcacaccttcctgtcagagtatccagaggccgcagagtatccacaccctggctgggtgtactggctacagatggctgtggctccaggtcacctgcgtgcctgggtgatgagaaataatgtcacaacaaatatcccatctgcattctctgggacactgacccatgaagagaaagcagttctcacagtttttacaggcacagccacagccgtgcatgtacaggtggcagctttagcttctgctaaactggagagctcagtgtttgtgacagactgcgtgtcctgcaaaatcgaaaatgtctgtgattcagctcttcagggaaaaagggtgccgatgtctggcctacagggctcaagcattgtcatcatgcccccatccaaccgtccactcgccagtgcggcatcctgcacgtggtcagtccaagtccagggagggccccatcacctgggggtggtcgctatcagtggcaaagtcttgtcagcagctcatggggcaggaagggcctatggttgggggtttcctggcgatcccatggaggaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110286 - DNA, 2998 bp, Homo sapiens
  Payload ID: 1638
  Gene Symbol: ABCG1
  Gene Name: ATP-binding cassette, sub-family G (WHITE), member 1
  Uniprot ID: P45844
  ENST ID: ENST00000398449
  CDS Start-End: 146-2146
gagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110287 - DNA, 3119 bp, Homo sapiens
  Payload ID: 1638
  Gene Symbol: ABCG1
  Gene Name: ATP-binding cassette, sub-family G (WHITE), member 1
  Uniprot ID: P45844
  ENST ID: ENST00000398457
  CDS Start-End: 261-2267
agacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtggcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgtcggcacatctgaagcttcaggagaaggatgaaggcagaagggaaatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccaccagcccagcgccaaactcttcgagctgttcgaccagctttacgtcctgagtcaaggacaatgtgtgtaccggggaaaagtctgcaatcttgtgccatatttgagggatttgggtctgaactgcccaacctaccacaacccagcagattttgtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggactcctcgtccatggaaggctgccacagcttctctgccagctgcctcacgcagttctgcatcctcttcaagaggaccttcctcagcatcatgagggactcggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatttcccctggagatgggagtctttcttcgggaacacctgaactactggtacagcctgaaggcctactacctggccaagaccatggcagacgtgccctttcagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtggccactttcgtgggcccagtgacagccatcccggtgctcctgttctcggggttcttcgtcagcttcgacaccatccccacgtacctacagtggatgtcctacatctcctatgtcaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaa

SEQ ID NO: 110288 - DNA, 918 bp, Homo sapiens
  Payload ID: 1638
  Gene Symbol: ABCG1
  Gene Name: ATP-binding cassette, sub-family G (WHITE), member 1
  ENST ID: ENST00000450121
  CDS Start-End: 147-918
agagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatgaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggatacaagaccctcctgaaaggaatttccgggaagttcaatagtggtgagttggtggccattatgggtccttccggggccgggaagtccacgctgatgaacatcctggctggatacagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccagcggcctggacagcgcctcctgcttccaggtggtctcgctgatgaaagggctcgctcaagggggtcgctccatcatttgcaccatccacc

SEQ ID NO: 110289 - DNA, 4479 bp, Homo sapiens
  Payload ID: 1639
  Gene Symbol: ABCG2
  Gene Name: ATP-binding cassette, sub-family G (WHITE), member 2 (Junior blood group)
  Uniprot ID: Q9UNQ0
  ENST ID: ENST00000237612
  CDS Start-End: 547-2514
actgcgttcagctctggcggtccacagcccgaagcgcggcttaggaagttcgtgtcagcgctgcctgagctcgtcccctggatgtccgggtctccccaggcggccacccgccggctcccatcgtgacctccagccgcagcgcctcccacgccggccgccgcgcgaggggagcgctcgggcgcgccgggtgtggttgggggaaggggttgtgccgcgcgcgggctgcgtgctgtgcccactcaaaaggttccgggcgcgcaggagggaagaggcagtgcccgccactcccactgagattgagagacgcggcaaggaggcagcctgtggaggaactgggtaggatttaggaacgcaccgtgcacatgcttggtggtcttgttaagtggaaactgctgctttagagtttgtttggaaggtccgggtgactcatcccaacatttacatccttaattgttaaagcgctgcctccgagcgcacgcatcctgagatcctgagcctttggttaagaccgagctctattaagctgaaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatgattttttcaggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattata

SEQ ID NO: 110290 - DNA, 451 bp, Homo sapiens
  Payload ID: 1639
  Gene Symbol: ABCG2
  Gene Name: ATP-binding cassette, sub-family G (WHITE), member 2 (Junior blood group)
  ENST ID: ENST00000505480
  CDS Start-End: 1-451
aaaaggttccgggcgcgcaggagggaagaggcagtgcccgccactcccactgagattgagagacgcggcaaggaggcagcctgtggaggaactggaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgc

SEQ ID NO: 110291 - DNA, 4276 bp, Homo sapiens
  Payload ID: 1639
  Gene Symbol: ABCG2
  Gene Name: ATP-binding cassette, sub-family G (WHITE), member 2 (Junior blood group)
  Uniprot ID: Q9UNQ0
  ENST ID: ENST00000515655
  CDS Start-End: 349-2184
gaaaaaaggaacccaaggagataggagagctgttaatttcactcgggacatttcctcgaggctagtttactcggaaagcctcaatgttccctggtagctgcaggatctactttgggggctgccaagtttcctctctcattctttctcctgccccaagagcaggcaggaaggaaagttcctggactgatactcgtctgtttagtaggcgtgggtcctggttgaagtctgtctaggaaaactcctaagtgtagaaatcttcttcgtattaccactgtctctgcactgagatttgggctgctttgcttccagcgtcacacatcataactgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgcgacctgccaatttcaaatgtaattcaggttacgtggtacaagatgatgttgtgatgggcactctgacggtgagagaaaacttacagttctcagcagctcttcggcttgcaacaactatgacgaatcatgaaaaaaacgaacggattaacagggtcattcaagagttaggtctggataaagtggcagactccaaggttggaactcagtttatccgtggtgtgtctggaggagaaagaaaaaggactagtataggaatggagcttatcactgatccttccatcttgttcttggatgagcctacaactggcttagactcaagcacagcaaatgctgtccttttgctcctgaaaaggatgtctaagcagggacgaacaatcatcttctccattcatcagcctcgatattccatcttcaagttgtttgatagcctcaccttattggcctcaggaagacttatgttccacgggcctgctcaggaggccttgggatactttgaatcagctggttatcactgtgaggcctataataaccctgcagacttcttcttggacatcattaatggagattccactgctgtggcattaaacagagaagaagactttaaagccacagagatcatagagccttccaagcaggataagccactcatagaaaaattagcggagatttatgtcaactcctccttctacaaagagacaaaagctgaattacatcaactttccgggggtgagaagaagaagaagatcacagtcttcaaggagatcagctacaccacctccttctgtcatcaactcagatgggtttccaagcgttcattcaaaaacttgctgggtaatccccaggcctctatagctcagatcattgtcacagtcgtactgggactggttataggtgccatttactttgggctaaaaaatgattctactggaatccagaacagagctggggttctcttcttcctgacgaccaaccagtgtttcagcagtgtttcagccgtggaactctttgtggtagagaagaagctcttcatacatgaatacatcagcggatactacagagtgtcatcttatttccttggaaaactgttatctgatttattacccatgaggatgttaccaagtattatatttacctgtatagtgtacttcatgttaggattgaagccaaaggcagatgccttcttcgttatgatgtttacccttatgatggtggcttattcagccagttccatggcactggccatagcagcaggtcagagtgtggtttctgtagcaacacttctcatgaccatctgttttgtgtttatgatggtctgttggtcaatctcacaaccattgcatcttggctgtcatggcttcagtacttcagcattccacgatatggatttacggctttgcagcataatgaatttttgggacaaaacttctgcccaggactcaatgcaacaggaaacaatccttgtaactatgcaacatgtactggcgaagaatatttggtaaagcagggcatcgatctctcaccctggggcttgtggaagaatcacgtggccttggcttgtatgattgttattttcctcacaattgcctacctgaaattgttatttcttaaaaaatattcttaaatttccccttaattcagtatgatttatcctcacataaaaaagaagcactttgattgaagtattcaatcaagtttttttgttgttttctgttcccttgccatcacactgttgcacagcagcaattgttttaaagagatacatttttagaaatcacaacaaactgaattaaacatgaaagaacccaagacatcatgtatcgcatattagttaatctcctcagacagtaaccatggggaagaaatctggtctaatttattaatctaaaaaaggagaattgaattctggaaactcctgacaagttattactgtctctggcatttgtttcctcatctttaaaatgaataggtaggttagtagcccttcagtcttaatactttatgatgctatggtttgccattatttaataaatgacaaatgtattaatgctatactggaaatgtaaaattgaaaatatgttggaaaaaagattctgtcttatagggtaaaaaaagccaccgtgatagaaaaaaaatctttttgataagcacattaaagttaatagaacttactgatattcctgtctagtggtataatatctcaggaatcttggctgagggtttggaactgtgggtagagtagagggccaggagtccagtaatagaattcttgcaccatttctggaacattctagctctgggaggtcacgtaaccttcttggggtagttcagtggtttagtggtttataatccaggtgtgcgtcagaatcatctgaggaactttgctaaaatacaaaaatctggcctaagtagctccagatctaccttcataaaggaatctgaccactcctggatttggtaatttccaagttctgaaaattttacttaggatttaataactattaacatctgtccctacataggttttctttcctacttatataccttatgttctcttcattctaaccttcatcagtaatagggaaatgttttaattttatttttttagttgaagggtaatgtaccaaaaaatatagttcagtgaattaaaatgaacacacatgtgcaaccatcaattcaggtcaagaaatagaagattgtagcacacaaaagcctactcagccattctcccagtcactacttccttccttacccctgggttatttttgaaatgacacttgatgtatttccctctgttgctgttatgagaacattgctacagccaagtgttgtgtttctgtgtgcataggttgatacttaattatctccccactttttaataaacttttaatttggaaataattttagattgacagaaaagttgcaaagatagtgaggaaagttcctgtctactctttgctcagcttcccttaatgttaacattttatatagcaagatgcatttgtcaaagctaacaagttaacattggtacaatcactgttaattaaactgcacacaatattcagatttcaccacttttccactaatattctttcattgttctaggattcaattcaggagaccacatttcatctagccctcttttttaaaagtaaatacttttcagcacttacaggagttaactgagctggggcatcatggtgtatagacgccctgacactggtcatcttggaattcatttagtttgtcagtgggtgccctgacattctgtcacaacatcaatttgggaacatggcattatatttttatctttgaacttttttctttttggatgacatttgattaatgcgtcatcttggaacacattatcttttttcttggttatgtgatcaggaagattaatcagtttttcctgttcttggtataattcctgcttttcacatacctgtcccttacagttctctatatatacccttcccttattacacagagagaaatatctatctatactttttacacaaaatatacttcaaaagaaacaaaacagccacaattattaactttttaaataaatgagaatttaattatatccta

SEQ ID NO: 110292 - DNA, 391 bp, Homo sapiens
  Payload ID: 1639
  Gene Symbol: ABCG2
  Gene Name: ATP-binding cassette, sub-family G (WHITE), member 2 (Junior blood group)
  ENST ID: ENST00000503830
  CDS Start-End: 1-391
agtgacggcgaccaaacccagctaggtcagacgagaaagataaaaactctccagatgtcttccagtaatgtcgaagtttttatcccagtgtcacaaggaaacaccaatggcttccccgcgacagcttccaatgacctgaaggcatttactgaaggagctgtgttaagttttcataacatctgctatcgagtaaaactgaagagtggctttctaccttgtcgaaaaccagttgagaaagaaatattatcgaatatcaatgggatcatgaaacctggtctcaacgccatcctgggacccacaggtggaggcaaatcttcgttattagatgtcttagctgcaaggaaagatccaagtggattatctggagatgttctgataaatggagcaccgc

SEQ ID NO: 110293 - DNA, 496 bp, Homo sapiens
  Payload ID: 1640
  Gene Symbol: ABCG4
  Gene Name: ATP-binding cassette, sub-family G (WHITE), member 4
  ENST ID: ENST00000524604
  CDS Start-End: 41-496
gggacgcgggtgccgcagcccgaggcaggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctg

SEQ ID NO: 110294 - DNA, 2459 bp, Homo sapiens
  Payload ID: 1640
  Gene Symbol: ABCG4
  Gene Name: ATP-binding cassette, sub-family G (WHITE), member 4
  Uniprot ID: Q9H172
  ENST ID: ENST00000615496
  CDS Start-End: 189-2129
aagggatggggagtgggacgcagccggaggcctgaagcctcctcctctccgccttcccctggtccgccctgcactcaccctgctaccccgacctcctagagcgggcagcctctgccggctgcctcttctcccccgccccctattccttcagtccccaggggctgctggcctgcggggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagcccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcct

SEQ ID NO: 110295 - DNA, 3852 bp, Homo sapiens
  Payload ID: 1640
  Gene Symbol: ABCG4
  Gene Name: ATP-binding cassette, sub-family G (WHITE), member 4
  Uniprot ID: Q9H172
  ENST ID: ENST00000619701
  CDS Start-End: 365-2305
aagaacggcgggaccggcgagcagtagctggtaggagagcgcagtcgccccgcgggctcggaggacacagcgtccgggaccaggctctgggaagcgggtgtgcacagcccagcagagtcagggcgcgaccccaaccgcctctcaccatccttgccgtctcctccgagccgagggccggccctcctgcctcgcctgccccgccccggccccgccccggcccgggccgccgggaccgggagccgggacgcgggtgccgcagcccgaggcaggtaaggggagccccggctctccgtccccggtccgtggcagcgctgagcatcccggccccgcaccggcccgggggcgcgtcaaggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagcccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcctgggagccctaggctctctagggccccacttacaactgaccaaagtggccccctctgggggtccccaccacacaagtgtttgtaaactgggctgctataaggttggagttccagggctgggccctggtggagtccactggaagtcccattatggatgttgaaatggacagggaaggactctggaagtctcttcctcctcctcctcttctctccacccctagaccctggctgacttggacaatctgccaggacagaagctgggttttctgtctaggtcaccactcccaatcctggggattggagaggcctggggctgtgggatgccccatccccctccccatcacctttggtgggggcagggcctggtggcacctgtgcaataatgtctgtgtttctctcccacctgccactggaactggagaatgcactttattctgggcggggggtgagtgggggaagacccaaccctcctttctcgctgcccctaacgcatgcacggtctcgtgatgctccctccctctccggagtgacaggcacatacatgagaacaggccatctcagccctacacacttgccatcccctacagcacagaggaagagtgatggtggcatgctggtggtggcgggtgctggtgggaggacagtgccaacctcctcctggggatcccatgttggagactctaaggataaggctggtgctgcccagggtgtctacaggaactgcaggtgtctacccccaagtcttccctcctcccaagccaggggtggcacagggcactagatccctggagttcaggaaccaacacaagcacaaccacgggcataagttggccttggccactgccacccacggccctccttttgtgctccatgctggcatcttcactcccctaccccttccccagccactgctgctcattcaaacttctgtccatgtccctccactgttcctatcagcaggtggcccctgggcatcagaacagcctgccctgggcaccaggtggcagacacactcagagcatgtctggctttcctggtgggtccaggctcattctgcttctgatttcccctcccccagggctcattttccccctttttcctgtacacatccctgtctacctcctctcaccctgccacagattcttcctatcacacagggatgccagttgtatttgtgggatttcacccattattaataaaacctatatttatacagta

SEQ ID NO: 110296 - DNA, 2553 bp, Homo sapiens
  Payload ID: 1640
  Gene Symbol: ABCG4
  Gene Name: ATP-binding cassette, sub-family G (WHITE), member 4
  Uniprot ID: Q9H172
  ENST ID: ENST00000622721
  CDS Start-End: 71-2011
ggagctttgagccgggctcggtggtctgccccaaactgagcaggccctccccttgcaggtcggcggcgtgatggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggcgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagcccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcctgggagccctaggctctctagggccccacttacaactgaccaaagtggccccctctgggggtccccaccacacaagtgtttgtaaactgggctgctataaggttggagttccagggctgggccctggtggagtccactggaagtcccattatggatgttgaaatggacagggaaggactctggaagtctcttcctcctcctcctcttctctcc

SEQ ID NO: 110297 - DNA, 2740 bp, Homo sapiens
  Payload ID: 1641
  Gene Symbol: ABCG5
  Gene Name: ATP-binding cassette, sub-family G (WHITE), member 5
  Uniprot ID: Q9H222
  ENST ID: ENST00000260645
  CDS Start-End: 141-2096
aagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctaaggtcatgctgtttgatgagccaaccacaggcctggactgcatgactgctaatcagattgtcgtcctcctggtggaactggctcgcaggaaccgaattgtggttctcaccattcaccagccccgttctgagctttttcagctctttgacaaaattgccatcctgagcttcggagagctgattttctgtggcacgccagcggaaatgcttgatttcttcaatgactgcggttacccttgtcctgaacattcaaacccttttgacttctatatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggcagatggatggtgagcaccactgctacagagcacccagtgattttactgaggattaaaataaaaaaccgtaggaatgggctcaacagtga

SEQ ID NO: 110298 - DNA, 2896 bp, Homo sapiens
  Payload ID: 1641
  Gene Symbol: ABCG5
  Gene Name: ATP-binding cassette, sub-family G (WHITE), member 5
  ENST ID: ENST00000405322
  CDS Start-End: 898-2340
gctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctatggacctgacgtcagtggatacccaaagcaaggaacgggaaatagaaacctccaagagagtccagatgatagaatctgcctacaagaaatcagcaatttgtcataaaactttgaagaatattgaaagaatgaaacacctgaaaacgttaccaatggttcctttcaaaaccaaagattctcctggagttttctctaaactgggtgttctcctgaggagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggca

SEQ ID NO: 110299 - DNA, 2512 bp, Homo sapiens
  Payload ID: 1641
  Gene Symbol: ABCG5
  Gene Name: ATP-binding cassette, sub-family G (WHITE), member 5
  ENST ID: ENST00000409962
  CDS Start-End: 1011-1409
aaggacgcgctggctaaaggtacatcagataatggtctccgtggccaagtcccagtcctgctgtcccaagggactccggggtcaggtggagcaggcagggcagtctgccacgggctccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaaggtggaggccgtcatggcagagctgagtctgagccatgtggcagaccgactgattggcaactacagcttggggggcatttccacgggtgagcggcgccgggtctccatcgcagcccagctgctccaggatcctagagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacct

SEQ ID NO: 110300 - DNA, 3033 bp, Homo sapiens
  Payload ID: 1641
  Gene Symbol: ABCG5
  Gene Name: ATP-binding cassette, sub-family G (WHITE), member 5
  ENST ID: ENST00000486512
  CDS Start-End: 896-1252
tccccaactgaagccactctggggagggtccggccaccagaaaatttgcccagctttgctgcctgttggccatgggtgacctctcatctttgacccccggagggtccatgggtctccaagtaaacagaggctcccagagctccctggagggggctcctgccaccgccccggagcctcacagcctgggcatcctccatgcctcctacagcgtcaggtaaggcagagcccttgctgctgctgctcccccaggagtgcggggcccggcgctcacccctctgctgcctttcttcactctttaagtgccagtctgggcacttcgggctccctctttagtggatcgggtggagagaggagagggagaagggctgtgctgggaaacatggagcgacagtgaatggcccctccccctgcccagggaagggcctgggcataaacaaagtggcagcagtgccctgccaacccagtgtctacggcctgccctctgtggatgggaatgggggtactgcgaatgcaaggagtcttgaaacctggtgaaagaatgcagggacagccacctcgcagccaaacggacaggacattcagagcaactccagcacaggccccctccctacgtggcagacagcctcagtcgctatctgccaggttctacagaggagggcgcagagactgaaacacgttaggagcctgtccggagactactggggtggggcacaggtaggatcaatgctggggacctgggtgtggccccttccagggccccaagctgcctttgccttcctggggtttcctttaaagccaccgcgtgaggccctggtgggacatcacatcttgccggcagcagtggaccaggcagatcctcaaagatgtctccttgtacgtggagagcgggcagatcatgtgcatcctaggaagctcaggctccgggaaaaccacgctgctggacgccatgtccgggaggctggggcgcgcggggaccttcctgggggaggtgtatgtgaacggccgggcgctgcgccgggagcagttccaggactgcttctcctacgtcctgcagagcgacaccctgctgagcagcctcaccgtgcgcgagacgctgcactacaccgcgctgctggccatccgccgcggcaatcccggctccttccagaagaagagacagggtctctctttgttgcccaagctggtctcaaactcctggcctcaagcaattctccctcctcagccttccaaagtattgggattacaggcatgagccactgcacccagcctctggggacgttttaaaaaattcatattatttatttaaatctgacacatgtattacgatttaagccgaattggatcatattattatcaaagacatgctttccccagggtgtggtgagtctggaagtggcccttggattcttgggcggtgtgctgcctctttcatgtcctccccagcccatgaattgaaatagcagccacagagactcccagccttcctgtaatttgtgtctcctgcaggtggaggccgtcatggcagagctgagtctgagccatgtggcagaccgactgattggcaactacagcttggggggcatttccacgggtgagcggcgccgggtctccatcgcagcccagctgctccaggatcctagagagtgacaagaaacttggtgagaaataagctggcagtgattacgcgtctccttcagaatctgatcatgggtttgttcctccttttcttcgttctgcgggtccgaagcaatgtgctaaagggtgctatccaggaccgcgtaggtctcctttaccagtttgtgggcgccaccccgtacacaggcatgctgaacgctgtgaatctgtttcccgtgctgcgagctgtcagcgaccaggagagtcaggacggcctctaccagaagtggcagatgatgctggcctatgcactgcacgtcctccccttcagcgttgttgccaccatgattttcagcagtgtgtgctactggacgctgggcttacatcctgaggttgcccgatttggatatttttctgctgctctcttggccccccacttaattggtgaatttctaactcttgtgctacttggtatcgtccaaaatccaaatatagtcaacagtgtagtggctctgctgtccattgcgggggtgcttgttggatctggattcctcagaaacatacaagaaatgcccattccttttaaaatcatcagttattttacattccaaaaatattgcagtgagattcttgtagtcaatgagttctacggactgaatttcacttgtggcagctcaaatgtttctgtgacaactaatccaatgtgtgccttcactcaaggaattcaattcattgagaaaacctgcccaggtgcaacatctagattcacaatgaactttctgattttgtattcatttattccagctcttgtcatcctaggaatagttgttttcaaaataagggatcatctcattagcaggtagtgaaagccatggctgggaaaatggaagtgaagctgccgactgtgcatgactgctctgaacgtctgaaatgagagtgccatgtatttctttcttgacaggacatctcaagtcttttaaccattaagactccatttgtgcctcttggatccaagcaggccttgaatgcaatggaagtggtttatagtcccttgctcttacaacttgcagggacatgtggttatttggaaattgtgactgagcggacccaagaatgtaaataatattcataaacctatgggagactcgtgtgactattttttttccttgttctaggcacagaaaaaaataggtcagcttaaaaatatgtttacattggataaaggattaggcaaaaataaaatgtttcaaggattcctgaccataagtgacagagaaagagagttgtgggtttagatgaagcaaggttatcatgcagaattgggtaagaatgcttctgttcctggaagacccagagttaaatgcagatgtccacacgaggggtcggagttacctgatcacatcgagagagtgctgggca

SEQ ID NO: 110301 - DNA, 2665 bp, Homo sapiens
  Payload ID: 1642
  Gene Symbol: ABCG8
  Gene Name: ATP-binding cassette, sub-family G (WHITE), member 8
  Uniprot ID: Q9H221
  ENST ID: ENST00000272286
  CDS Start-End: 91-2112
ctccaggaaacagagtgaagacactggccctggcaggcagcagctgggtctaagagagctgcagcccagggtcacagacctgtgggccccatggccgggaaggcggcagaggagagagggctgccgaaaggggccactccccaggatacctcgggcctccaggatagattgttctcctctgaaagtgacaacagcctgtacttcacctacagtggccagcccaacaccctggaggtcagagacctcaactaccaggtggacctggcctctcaggtcccttggtttgagcagctggctcagttcaagatgccctggacatctcccagctgccagaattcttgtgagctgggcatccagaacctaagcttcaaagtgagaagtgggcagatgctggccatcatagggagctcaggttgtgggagagcctccttgctagatgtgatcactggccgaggtcacggcggcaagatcaagtcaggccagatctggatcaatgggcagcccagctcgcctcagctggtgaggaagtgtgtggcccacgtgcgccagcacaaccagctgctccccaacttgactgtgcgagagaccttggccttcattgcccagatgcggctgcccagaaccttctcccaggcccagcgtgacaaaagggtggaggacgtgatcgcggagctgcggcttaggcagtgcgctgacacccgcgtgggcaacatgtacgtgcgggggttgtcggggggtgagcgcaggagagtcagcattggggtgcagctcctgtggaacccaggaatccttattctcgacgaacccacctctgggctcgacagcttcacagcccacaacctggtgaagaccttgtccaggctggccaaaggcaaccggctggtgctcatctccctccaccagcctcgctctgacatcttcaggctgtttgatctggtcctcctgatgacgtctggcacccccatctacttaggggcggcccagcacatggtccagtatttcacagccatcggctacccctgtcctcgctacagcaatcctgctgacttctatgtggacctgaccagcattgacaggcgcagcagagagcaggaattggccaccagggagaaggctcagtcactcgcagccctgtttctagaaaaagtgcgtgacttagatgactttctatggaaagcagagacgaaggatcttgacgaggacacctgtgtggaaagcagcgtgaccccactagacaccaactgcctcccgagtcctacgaagatgcctggggcggtgcagcagtttacgacgctgatccgtcgtcagatttccaacgacttccgagacctgcccaccctcctcatccatggggcggaggcctgtctgatgtcaatgaccatcggcttcctctattttggccatgggagcatccagctctccttcatggatacagccgccctcttgttcatgatcggtgctctcatccctttcaacgtcattctggatgtcatctccaaatgttactcagagagggcaatgctttactatgaactggaagacgggctgtacaccactggtccatatttctttgccaagatcctcggggagcttccggagcactgtgcctacatcatcatctacgggatgcccacctactggctggccaacctgaggccaggcctccagcccttcctgctgcacttcctgctggtgtggctggtggtcttctgttgcaggattatggccctggccgccgcggccctgctccccaccttccacatggcctccttcttcagcaatgccctctacaactccttctacctcgccgggggcttcatgataaacttgagcagcctgtggacagtgcccgcgtggatttccaaagtgtccttcctgcggtggtgttttgaagggctgatgaagattcagttcagcagaagaacttataaaatgcctctcgggaacctcaccatcgcggtctcaggagataaaatcctcagtgtcatggagctggactcgtaccctctctacgccatctacctcatcgtcattggcctcagcggtggcttcatggtcctgtactacgtgtccttaaggttcatcaaacagaaaccaagtcaagactggtgattcacgccagacgtctgcccgctggtgggggacctgagcagacccttcaactgcactccctcctcaggagccccttcctggggacagtgaggacaatgaccctacagatgctcagctacatccggcccagggtgctgcagtggcacagaccagccacaggatggcagtagaataaagacagtcgaaagggatttctgctcactggcaggagactgcgatgactgggagaaaacctgcactcggtggcacctacaacgttgctaatttatttccttttgatatgcatttatataggcaactcgatataggatgggagcaaactaggaatgaattgggtagctagactgtgcaggaattgttggaacctggagggaacaataacagtagctagcagatttggcttcatcttccaggggccccacactccgtggtgagccaccatcaatacagaaagtgacctaagatgtaccagcaagatgccatcccttctttttgtgtggggtcatgggctccaaaagccaacgtgaacaattaaaaatgtattgagcatcta

SEQ ID NO: 110302 - DNA, 2509 bp, Homo sapiens
  Payload ID: 1643
  Gene Symbol: ATRIP
  Gene Name: ATR interacting protein
  Uniprot ID: Q8WXE1
  ENST ID: ENST00000346691
  CDS Start-End: 114-2408
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 110303 - DNA, 2590 bp, Homo sapiens
  Payload ID: 1643
  Gene Symbol: ATRIP
  Gene Name: ATR interacting protein
  Uniprot ID: Q8WXE1
  ENST ID: ENST00000320211
  CDS Start-End: 114-2489
gggcactcgcggcggaggcaagcggcggcgcgcggacggttggtccagttctccggcctggcggcaggcaagtctagctcggcgctgtcggatacttggggtgagcggaaagcatggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 110304 - DNA, 2721 bp, Homo sapiens
  Payload ID: 1643
  Gene Symbol: ATRIP
  Gene Name: ATR interacting protein
  Uniprot ID: Q8WXE1
  ENST ID: ENST00000412052
  CDS Start-End: 463-2559
gtgagtgctcctcgcggccttttgctcggagggagttgtcaaccgcgccagatccccttgatggctgtggcttcggaacctcgcggccagcactgccttttcgcctttttaaaatatgggaacaccctgatttaagcagcggttgtcttccagaaggtcctttgattttagggggaaatgcattagccaggtcaaacagccgatttgaaacacagaaggctaagttgacattttacgttattttctaaagtttaggccacttggttcttggttctaagcagagatccttggaacacacctaccaccaccatcagaaccatcactacccatgcatggggacccattcttgtgacaagtttgagcggctttagatcttatgaagcccactgtctcccttgggcagtgtgagcatgggaggagccagacacaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccgg

SEQ ID NO: 110305 - DNA, 793 bp, Homo sapiens
  Payload ID: 1643
  Gene Symbol: ATRIP
  Gene Name: ATR interacting protein
  ENST ID: ENST00000635082
  CDS Start-End: 123-518
gattggcccctgggccaggggcggggcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcat

SEQ ID NO: 110306 - DNA, 711 bp, Homo sapiens
  Payload ID: 1643
  Gene Symbol: ATRIP
  Gene Name: ATR interacting protein
  ENST ID: ENST00000635099
  CDS Start-End: 123-711
gattggcccctgggccaggggcggggcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaac

SEQ ID NO: 110307 - DNA, 1874 bp, Homo sapiens
  Payload ID: 1644
  Gene Symbol:
  Gene Name: ATR interacting protein [Source:EntrezGene
  Acc:84126]
  Uniprot ID: Q9NSU2
  ENST ID: ENST00000296443
  CDS Start-End: 888-1832
gctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgcccc

SEQ ID NO: 110308 - DNA, 2403 bp, Homo sapiens
  Payload ID: 1644
  Gene Symbol:
  Gene Name: ATR interacting protein [Source:EntrezGene
  Acc:84126]
  Uniprot ID: Q8WXE1
  ENST ID: ENST00000357105
  CDS Start-End: 308-2302
gattggcccctgggccaggggcggggcactcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagctttgcaagaaagcagacacttcatatcaccatctgtaggtccctaagaaaaccaggaatatgtggaattttagttgtgcaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactgg

SEQ ID NO: 110309 - DNA, 4046 bp, Homo sapiens
  Payload ID: 1644
  Gene Symbol:
  Gene Name: ATR interacting protein [Source:EntrezGene
  Acc:84126]
  ENST ID: ENST00000634384
  CDS Start-End: 96-236
actcgcggcggaggcaagcggcggcgcgcggacggttggtccagttctccggcctggcggcaggtgatcataaggtccacagattattagatggcatgtcaaaaaatccttcagggaaaaacagagaaactgttccaattaaagataatttcgaattagaggtacttcaggcacaatacaaagaacttaaagaaaagctttgcaagaaagcagacacttcatatcaccatctgtaggtccctaagaaaaccaggaatatgtggaattttagttgtgcaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgcgtgagctctggggtagagaccaaccctgaggactcagtgtgcatcctggaaggcttctctgtgactgcacttagcattcttcagcacctggtgtgccacagcggagcagtcgtctccctattactgtcaggagtgggggcagattctgctgctggggaaggaaacaggagcctggttcacaggcttagtgatggagatatgacctcagccctaaggggggttgctgatgaccaaggacagcacccactgttgaagatgcttcttcacctgttggctttctcttctgcagcaacaggtcaccttcaagccagtgtcctgacccagtgccttaaggttttggtgaaattagccgaaaacacttcctgtgatttcttgcccaggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 110310 - DNA, 3943 bp, Homo sapiens
  Payload ID: 1644
  Gene Symbol:
  Gene Name: ATR interacting protein [Source:EntrezGene
  Acc:84126]
  ENST ID: ENST00000635464
  CDS Start-End: 1-1395
atggcggggacctccgcgccaggcagcaagaggcggagcgagcccccggcgcctcgccccggcccgccgccgggcaccgggcaccccccgagcaagcgggcccggggcttctccgcagccgctgccccggaccctgacgacccgttcggcgcgcatggggacttcactgccgacgacctggaggagcttgacaccctcgcgtcacaggccctgagccaatgtccggccgcggctcgggacgtgtccagtgatcataaggtccacagattattagatggcatgtcaaaaaatccttcagggaaaaacagagaaactgttccaattaaagataatttcgaattagaggtacttcaggcacaatacaaagaacttaaagaaaagatgaaagtaatggaagaagaagttctcattaagaatggagaaattaaaattttgcgagactcactacatcagacggaatccgttctagaggaacagagaagatcacattttcttcttgagcaagagaaaacccaagcactcagtgacaaggaaaaggaattctccaaaaagctccaatcattgcagtctgaactccagtttaaagatgcagagatgaatgaattaaggacaaagctccagaccagtgaacgagcaaataaactggctgctccctctgtttcccatgtcagtcctaggaaaaacccttctgtggttataaagccagaagcatgttctccacaatttggaaaaacatcttttcctacaaaggagtcttttagtgctaacatgtcccttccccacccctgccagacggagtcaggatacaagcctctggtgggcagagaggatagtaagccccacagtctgagaggtgactccataaaacaagaagaggcccagaaaagctttgttgacagctggagacagagatcaaacactcaaggttccattttgataaacctgctcctgaagcagcctttgatcccagggtcatccctaagcctttgccacctcctgagtagtagttctgagtctcctgctggcacccccctgcagccaccagggtttggcagtaccttggctggaatgtcaggcctcaggaccacaggttcttatgatgggtcattttccctctcagccctgagagaagcacagaacctggcattcactggactgaatctggttgcccggaatgagtgctcacgtgatggagacccagcagagggaggcagaagggccttcccactctgccagcttcctggagccgtgcatttcctcccccttgtacagttcttcatcggcttacactgccaggccctgcaggacttggcagctgctaagagaagcggagcacctggggactcaccgacacattcctcctgccaacaggtcaccttcaagccagtgtcctgacccagtgccttaaggttttggtgaaattagccgaaaacacttcctgtgatttcttgcccagagccgcaagattggggagaactgtgaacacaaccagcccaccccctcatccagtaatccagtctccctcagcactctaccaaagggttccagtgtgtgttccaagtgctgccaaagtgcctcagcccagagacacccctgcctagcgtgctgctggctgttgagctcctctccctgctggcggaccacgaccagctggcacctcagctctgttcccactcagaaggctgcctcctgctgctgctgtacatgtacatcacatcacggcctgacagagtggccttggagacacaatggctccagctggaacaagaggtggtgtggctcctggctaagcttggtgtgcagagccccttgcccccagtcactggctccaactgccagtgtaatgtggaggtggtcagagcgctcacggtgatgttgcacagacagtggctgacagtgcggagggcagggggacccccaaggaccgaccagcagaggcggacagtgcgctgtctgcgggacacggtgctgctgctgcacggcctatcgcagaaggacaagctcttcatgatgcactgcgtggaggtcctgcatcagtttgaccaggtgatgccgggggtcagcatgctcatccgagggcttcctgatgtgacggactgtgaagaggcagccctggatgacctctgtgccgcggaaaccgatgtggaagaccccgaggtggagtgtggctgaggccctgagtgtccagccacatggtggcaccagcaccactcctttccttaccacatcaactgattaaagcagtgaccagcaggaactgcccagagaactggctggccttgtttcctgagtctgatctgtttggcggagtgggaggggtggagcaggacccggaccctgagtggctgggatccttcttcctgtccctggctgttgctgagcccgtccccatggtaactgatctgccttgaggaaggagccctgccctgcctgtggaattgtcctgagtcattgctttgggctggggccatgggaagaaaccattgtgtggcagggaaggaggtggctcttggcccaggcctaaaccaggaaagcctgggaaactgggacccacaggtgggcatgaaagggccgcagcaggggctcccagcagtgtgtaagaccgggagctggtctggcaccactgccctggtccttccagctgcctgtcactggtatgatggccccggtgcattgtgccaccagcaggccacagctgtggatcttggaaggcctctggggtcccccgggagcaggggagtgggtgtgggggggaacggatggtggtgagagggacagaccaggcaggctgacgagcagggcgggcctggctcacgtgggcctgtaggcgggcccacgccaagtttcacttcccgccactgctgccagcgagagccgcgggagagtgtgcagccgagtcactactgcctgcctgcctgcctgctacggctcagcagcaggtacgtacccaaccatgggctcgcaggccctgcccccggggcccatgcagaccctcatctttttcgacatggaggccactggcttgcccttctcccagcccaaggtcacggagctgtgcctgctggctgtccacagatgtgccctggagagcccccccacctctcaggggccacctcccacagttcctccaccaccgcgtgtggtagacaagctctccctgtgtgtggctccggggaaggcctgcagccctgcagccagcgagatcacaggtctgagcacagctgtgctggcagcgcatgggcgtcaatgttttgatgacaacctggccaacctgctcctagccttcctgcggcgccagccacagccctggtgcctggtggcacacaatggtgaccgctacgacttccccctgctccaagcagagctggctatgctgggcctcaccagtgctctggatggtgccttctgtgtggatagcatcactgcgctgaaggccctggagcgagcaagcagcccctcagaacacggcccaaggaagagctatagcctaggcagcatctacactcgcctgtatgggcagtcccctccagactcgcacacggctgagggtgatgtcctggccctgctcagcatctgtcagtggagaccacaggccctgctgcggtgggtggatgctcacgccaggcctttcggcaccatcaggcccatgtatggggtcacagcctctgctaggaccaagccaagaccatctgctgtcacaaccactgcacacctggccacaaccaggaacactagtcccagccttggagagagcaggggtaccaaggatcttcctccagtgaaggaccctggagccctatccagggaggggctgctggccccactgggtctgctggccatcctgaccttggcagtagccacactgtatggactatccctggccacacctggggagtaggccaagaaggaaaatctgacgaataaagacccccgctgccccata

SEQ ID NO: 110311 - DNA, 8249 bp, Homo sapiens
  Payload ID: 1645
  Gene Symbol: ATR
  Gene Name: ATR serine/threonine kinase
  Uniprot ID: Q13535
  ENST ID: ENST00000350721
  CDS Start-End: 123-8057
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 110312 - DNA, 553 bp, Homo sapiens
  Payload ID: 1645
  Gene Symbol: ATR
  Gene Name: ATR serine/threonine kinase
  ENST ID: ENST00000515810
  CDS Start-End: 1-120
gcgccactgaatgaaactggagaagttgtcaatgaaaaggttagtagaagatggcaagttcttcaaattcatttaagtaacgtgaagtttgtgcttcaaagggtacttcccttgatctgattttctggatatgagaaatagcctcacaaggatcctgatgaactctctctttagtggacctcattaagccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaata

SEQ ID NO: 110313 - DNA, 718 bp, Homo sapiens
  Payload ID: 1645
  Gene Symbol: ATR
  Gene Name: ATR serine/threonine kinase
  ENST ID: ENST00000504521
  CDS Start-End: 1-243
cataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaagatggcaagttcttcaaattcatttaagtaacgtgaagtttgtgcttcaaagggtacttcccttgatctgattttctggatatgagaaatagcctcacaaggatcctgatgaactctctctttagtggacctcattaagccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataca

SEQ ID NO: 110314 - DNA, 5190 bp, Homo sapiens
  Payload ID: 1645
  Gene Symbol: ATR
  Gene Name: ATR serine/threonine kinase
  ENST ID: ENST00000513291
  CDS Start-End: 1-1372
tgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggttagtagaaggtatagcttgatatgggctgtagtcctcatctctacaaatgaacttgatatgcagctatagttctcatctctatgcatgagaactgcttggaaatactgttagtgactattgattactctgaaatctagttctctagtatcacaatgccataagttttctttattgtcagtaatgttaacagtattcgcatttgtataataaaagttcatggcacacttgtttaaccatagacaattcacagttatgagatacagtaggaaaaactatagtacaaattgcctgaacttacagaacaacaggtctgagctttaatatcatgataccagtatgtcacaagctatgttaacaaatgcagcaattcacttcttacttagttgaagctgcaaagtttgcagatagttttgttgttgttgttgtggtggtggtggtggttgttgtttttgagacagagtctcgctctgtcatccaggctggagtacagtggcacgatcttggctcacggcaacctctgcctcctgggttcaagcagttctcctgccttagcctcccaagtagctgggattataagcgtgcaccaccacagctggctaattattatatttttagtagagatgggtttcaccatgttggccaggctggtcttgaacccctggcttcaagtgatccacccacctcagcatcccaaaatgcagggattataggcataagccactgtgcctagctcagatagttgtttttaataagttagaatagattgaggattcgttttttttggtggggggcactcttacatctttaataagtcttgtacaggcttactaaatacaatgaattataccaactatatgctaataaagattaaaaatttacattccagttaactacctaaagagtttaagtccactttcatcctactgatatagctcgaggaaggctagacctgtacgcccccatccttcatgtcatccttaaccctttgtcttgagaaagaaggtttagctgcttctttagttcttctaaaagaactaaaagaaaaatttctttttcttgctctattatcttcatctgtagggtgagattaatatttccagaattgtggaaaaattcactctgtagcagttgaagagcagatggtctctgggacatgttccttttcgttaagtgatagatatacttggcttgtactggataccttttactgagggattccaatatctgaccagttcttgaacctgttaaaacttctgctcgctccatttctgttctaaacagctgaaagagctctagcaggatcacactcaagctatatacatatctaactggacaaagccagccctggtctctacaaatagtttttgtttttttttaattagctgggctcagtggcacactcctgtagtcccagctacttgggaggctgaggtgggaggatcacttgaccccaggagttggaggctgctgtgagctatgatgacaccactgcactccagcctgggcaacagagtgagacccttggcatcatactcagatccttccaactgctgggatgaagcatacagacaagtgcccactctggatataggtgttggtgttctctttctgtttctatgggtccagtctgtgttcttttgtaagatgtctgggcaagccagaccaaagtctcctatttttacttgctgatcagggccatgaagaaaaatatttctaggcttcagatctctgtttacaatacccatgttatgtatgtaaaacacaccttccactaaatcttgaaaattttttgttgcaacactggccataaggacaggcaaacttgcccacacactcttggccctgtttgtttctctcagctagccagtcccacagctggagcttgcacacctgcatctggatgtgcagcatcaggtggtactgcacctcgatccccaacaagttgaagttttctttggaagattcctcagtggatgtgaaattctcctctaggagggaattacacctgagcagcaggggctgtttcacaattgaccaggtagacaaaccagccaggccattttcctggagctccagggatgattcatattcactggtgtctcttaagacggaattgatggtgtagttcacagcttgttgttctgattttgagtgtcagattctgcaaagggtttttcttttctgaggtgagctccgcgaagataatgggtgagctgctattttcaccatttttaacaccgtattggtatctgtctgcttggtcggagaacacttccagaaatggcaactgaacggaagctctgtctgcttgtggttggaccacttgaacatgttctgtccacgcagtgtgataacgaatgatattagggtgctgaagacctgccagcaccttcattccccgtagttctttcatgtaatgtgtttttgttgcacccttaatcaggattttttaaattgcataatactgaccatctaatttattcctgaccttgtatactcttccatatccaccttttcctaagatggcaagttcttcaaattcatttaagtaacgtgaagtttgtgcttcaaagggtacttcccttgatctgattttctggatatgagaaatagcctcacaaggatcctgatgaactctctctttagtggacctcattaagtgagtaatagctctgtggtgatgtagtctcaatgagctaaacttgtcacaagtgaaagaagacagcagccccattttgataaaggtctggcaaagtaacttaaacactgtcttgaatgaactgggtttggttcacgcacatggctcaagtgcttcaccaaagaaataagcggcagctggtttgcaactgcaaaagggaaagttggctgttgtaggggttattttaatacctggagttctgctggaacataagtcatatttggagtccaggctcttggcggaaaagtcgatggcagatggcacagcaacagtctccaccccgtggccctcctctttgtgctcgtgggctgcagcgcagcccaccagcccacccagcaccacctctgagaattattcttctaataacgttattcttccttttgcattcagatatgcttaagaaattgtacagttccaagtagctcacttagaacacccatttgcatgtactaacataatgtaaatattaggcagtacagcattgttatttgaatattcattgaaatgtttaagtcctaaacacttccaaagcagatttaaaaaattatttttctagaattgtaatgtgtaaataattccctggtatttcacgtagtccagaaacatgtccaagcagttgatgttgaatcaatcttgcgagcctccaaatcagtatcacaagctaactgtatttgtttaatttcttcttttcctgtatttgctcttacaaaaggggtattggtcagtaaaatggtattaacatttattaaatgtcaaaatataaagaaaggtagtaattccaaattattaacatctgtttttggttttatgtttcttctttttaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaat

SEQ ID NO: 110315 - DNA, 929 bp, Homo sapiens
  Payload ID: 1645
  Gene Symbol: ATR
  Gene Name: ATR serine/threonine kinase
  ENST ID: ENST00000515149
  CDS Start-End: 1-929
atgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttat

SEQ ID NO: 110316 - DNA, 724 bp, Homo sapiens
  Payload ID: 1645
  Gene Symbol: ATR
  Gene Name: ATR serine/threonine kinase
  ENST ID: ENST00000507148
  CDS Start-End: 21-323
tagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattgtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgaga

SEQ ID NO: 110317 - DNA, 4351 bp, Homo sapiens
  Payload ID: 1646
  Gene Symbol: ATN1
  Gene Name: atrophin 1
  Uniprot ID: P54259
  ENST ID: ENST00000356654
  CDS Start-End: 238-3810
gacgccatactggacgccaagtgggaggaacttcaaggctgtcccctgcgggcctcccgctctgcttctgcgaaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccaggaa

SEQ ID NO: 110318 - DNA, 4290 bp, Homo sapiens
  Payload ID: 1646
  Gene Symbol: ATN1
  Gene Name: atrophin 1
  Uniprot ID: P54259
  ENST ID: ENST00000396684
  CDS Start-End: 235-3807
ccgccgccccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgagcaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcctgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatgggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctctt

SEQ ID NO: 110319 - DNA, 8633 bp, Homo sapiens
  Payload ID: 1647
  Gene Symbol: ATRN
  Gene Name: attractin
  Uniprot ID: O75882
  ENST ID: ENST00000262919
  CDS Start-End: 69-4358
ggcgaagcggagccggccgtgcggtgtgtgtgtatgtgttcgcggggcgccgtctcagccccgggaagatggtggctgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctctcgccgccgctgctgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataaccccatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctacgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcagattgccttctctcagcacagcaattttatggacctggtacagttcttcgtgactttcttcagttgtttcctctctttgctcctggtggctgctgtggtttggaagatcaaacaaagttgttgggcctccagacgtagagagcaacttcttcgagagatgcaacagatggccagccgtccctttgcctctgtaaatgtcgccttggaaacagatgaggagcctcctgatcttattggggggagtataaagactgttcccaaacccattgcactggagccgtgttttggcaacaaagccgctgtcctctctgtgtttgtgaggctccctcgaggcctgggtggcatccctcctcctgggcagtcaggtcttgctgtggccagcgccctggtggacatttctcagcagatgccgatagtgtacaaggagaagtcaggagccgtgagaaaccggaagcagcagccccctgcacagcctgggacctgcatctgatgctggggccagggactctcccacgcacgagctagtgagtggcacaccagagccatctgcagggaagggcgtggcggggaaatggctgtgcggtgcgggacggaagactggaaaccctcaaagcatctgactcacctgcatgatcacaagctttctttgacggtttctcccatccgtgttccagcatctaaccttttacttttgcataggaaatacttgatttaattacaggtccagggatgagctgatggttgctggaggaggccagtgtagagccagtgagagaactaggaatgacactcaggttcactgtggaaaactgttcttgggactgtctcaactgtgcaaaaaacaaaagatggagtgtttacaagtagacattcgtcatcagttgttcttgaacatggtcttttaaaaactagtcagatgaattgttttcatctgaagcctgctatcttttttaaaagatgtgctatttattcttgcacgatttaggcaattatctctcttccagggagtacctttttttctagttgagaattaataatggtccatctcttttgatcatatcaagctaggatagaaggggggctattttaaatgtcaaggtcagcagtgttactttgaatgtaaactggtataataggtagttttctatagtaacttgattaatttagtcttaatccatttgaaactctctcttcctttctctctgcctgtccctctccttctccatctcaccctccctctctcacacatacacacacaaacacatacacacaacactaagtgcctagactttaaatagatctagcaattggaaagttagtaagcctaagtttttacataattgcattcctacattcttgtaaaatttaaatagctaccattggcaatctgctttttttctaaaatctgatttgcagccaggaaagaattttctcacccaaggaacatttgatctagcagcagggatgagaggaaagcagaaatgaatgaactgtgaaagctcctgtttttattatcaaaaaggacactgtcaagaaggcgccccctgcccccacccccgtgtcaccctaggcctgataagcgatcagaggaaaggactcattcatgtcacgcttccttgagcagaaaagagcactgagagcacttgggacccctggatcagagagcatctgtgtgtcctgcagcctcctctgaacttgtggttcattctcaggctggggtggactcagatgccaggaaagggacagcctcccattgtcaggcagaagctgcccaaagcctggagaaggacttgtttgccctctttcccccaggaggggctcgacccacccaccctccctctcagaccaaggtggtggctgtgaggagggcagcaaatgctgacaaggatgaaaagcacatggaaaaaaatggatgaggagggaaaactctgccaaatggaaaatgaccaaatttaagagggtgggacagtcccctgctcctctcccagagggcactgcttggaaattgtgttttccccatttatggtgctctgtattctggcattatgcagcagcctcccagaagctctcttctgcttcaaaacctgggatctctggcattaccctattgggatggaccgctggacagcaatgctcgagtttgtgaatttggagagatactcaaaagagctaaaactgcagcattttacctttaaatgcagtgcctagagagagagtattgtctcttccccaacactaaccccactcccatgaagaattgcctggaaagatgttttcaaggaatttgaaccataaaacactatctgatgcacagaacacctctactttgagactcacctctcataaagcttctttttcacattactgttaaagaccagacgttctagaaaagacccctcctctcatgagctcccccatccctgctacagaacacagcacccatggcgcctgcagtggactggccccttaattcccacaggcccccccagcaaggccaaagggaggcccctgggtattgtcctcctacaaggaagatcctctttgtttgttcaaaggaccagttttcctaggccaaagaagtctcttccccatgttagtcctatgccttgaaatatcatgcaccatgacccacagccatctggttatgtcttatttttttcctaaaagataatgtttatttttaaaaaggaaggaaggagcaagtgaagtttcattctgctccagcggtggggaagccgctgaatccacctgcttctcctttgcaaccgacagcaaacagctttctccggcctcagggcagaaaaagggaatggcagggagtaagaggcgctgggctcggagcctgtttccaagaaggaattggttgtcatctggcagtgttgcgcgtcacaagagagcctgtatataaattaaaatagtcaagacaacactgaccttgcacttgtacataactatacagtagtgtccagaatgttcagacattcggagtgtacataaaacagaaaaaatcttcatgtatttttattaaatataacaatgtctgagtttcacctaagatgtttttgtgccatatgctggatatccaggttctcgccaggccccgatacatgaataacaaacccaagaaacgcatccccattgtgtgatgtgttcagatgcatctggcaccaattaggtatttcttaaaacaggactcatctgtcagagtgcacatgaaaaatcaggcagggaatcgaaacgacagtgctggaggagactcaggaagcagaggcgtccctgccgctgcccttggccctgcaagcacatcatgaccctttctggcagcctcttggtgctctgggtagtgagggatgaccagtcttgtcctgagaaatgtttctcttagtctttaagttcaaagactaacctgtagcaatcagactttccaaaagggggttctccattttttgtagttttgtctaaatttttaatgaccatttcctggaatcagtttattatactgaaaactgggggtgggagtagggagctagtttgttgataaatagttcccatttccccatggagaatttgacataccctggactcctgtgtgcctcctgccatccctgcacacagcctggggagaagcctgtgcctccccgtgtggagagaaggcaaccccagatcccctgagctaacccggaggaaaggcagtcctggacagaagactgtcagcagaaggaaagtactggactacccgtgggtaagtcctgccattcaagactggagacacctgggaaataaaaagagcagggcactgctggtgggaagaggcattttaccttccagtgcaaatcctgctcctttgatttaatggggtgtactggggccaggggctgattcacttccttgggagatggtggtgttttcatgaacatctttgatccttccatttcatttattcatccatccattcaacaagtatttgctaaacactaacttaagctaatgctagggtagtgactgagatgtaaaaatagattttagaattaaaacaaaatccaagtcctcacacccctgtcatcccaggagatctttccttgtggtggtttctgtgagaattggccatcctgaggacacagccaggacggcagaggcctcctggcctcagggcatgccctgcctaccttctgaaatgtttaccccattgaccaaacttggctccagccattgcggtggtttctagatagccaggcccaccaagagatattgccccttgatgagagtcaaacaccctgcctacaaggagatgttttgaaatggagaggaaaattggcacctcatcttttaaaggcagtaatggaattgattttcagtaactgaatttgtgcacaaaacattctaaacactagtgaagcctgtttcgttgaactaattctggctctggaaatgtttttgttttatagttatttacgatttcgtttgtttggattcaagcttagtttgttaatatgtataatttagcatctattacactcatgtaaatatggagtaagtattgtaaactatttcatcgcggggattgtgggtgttatacatacatttaggactgcaattttttggtattttttgtattgtaaaataacagctaatttaagcaggaacaagagaactaagggaggtctgtgcattttaaacacaaatgtgaagaacttgtatataaacaaaagtaaatactataatacaaacttccttctgaaataaaagtagatctggtaaaaatgtg

SEQ ID NO: 110320 - DNA, 3921 bp, Homo sapiens
  Payload ID: 1647
  Gene Symbol: ATRN
  Gene Name: attractin
  Uniprot ID: O75882
  ENST ID: ENST00000446916
  CDS Start-End: 1-3819
atggtggctgcagcggcggcaactgaggcaaggctgaggaggaggacggcggcgacggcagcgctcgcgggcaggagcggcgggccgcactgggactgggacgtgaccagggctgggaggccggggctgggggccgggctgcgcctcccgcggctgctgtctccaccgctgcggccacggctgctgctgctgctgttgttgctctcgccgccgctgctgctgctgctgctgccctgtgaggccgaggccgcggcggcggcggcggcggtgtcgggctcagccgcagccgaggccaaggaatgtgaccggccctgtgtcaacggcggtcgctgcaaccctggcaccggccagtgcgtctgccccgccggctgggtgggcgagcaatgccagcactgcgggggccgcttcagactaactggatcttctgggtttgtgacagatggacctggaaattataaatacaaaacgaagtgcacgtggctcattgaaggacagccaaatagaataatgagacttcgtttcaatcattttgctacagagtgtagttgggaccatttatatgtttatgatggggactcaatttatgcaccgctagttgctgcatttagtggcctcattgttcctgagagagatggcaatgagactgtccctgaggttgttgccacatcaggttatgccttgctgcatttttttagtgatgctgcttataatttgactggatttaatattacttacagttttgatatgtgtccaaataactgctcaggccgaggagagtgtaagatcagtaatagcagcgatactgttgaatgtgaatgttctgaaaactggaaaggtgaagcatgtgacattcctcactgtacagacaactgtggttttcctcatcgaggcatctgcaattcaagtgatgtcagaggatgctcctgcttctcagactggcagggtcctggatgttcagttcctgtaccagctaaccagtcattttggactcgagaggaatattctaacttaaagctccccagagcatctcataaagctgtggtcaatggaaacattatgtgggttgttggaggatatatgttcaaccactcagattataacatggttctagcgtatgaccttgcttctagggagtggcttccactaaaccgttctgtgaacaatgtggttgttagatatggtcattctttggcattatacaaggataaaatttacatgtatggaggaaaaattgattcaactgggaatgtgaccaatgagttgagagtttttcacattcataatgagtcatgggtgttgttgacccctaaggcaaaggagcagtatgcagtggttgggcactctgcacacattgttacactgaagaatggccgagtggtcatgctggtcatctttggtcactgccctctctatggatatataagcaatgtgcaggaatatgatttggataagaacacatggagtatattacacacccagggtgcccttgtgcaagggggttacggccatagcagtgtttacgaccataggaccagggccctatacgttcatggtggctacaaggctttcagtgccaataagtaccggcttgcagatgatctctaccgatatgatgtggatacccagatgtggaccattcttaaggacagccgatttttccgttacttgcacacagctgtgatagtgagtggaaccatgctggtgtttggaggaaacacacacaatgacacatctatgagccatggcgccaaatgcttctcttcagatttcatggcctatgacattgcctgtgaccgctggtcagtgcttcccagacctgatctccaccatgatgtcaacagatttggccattcagcagtcttacacaacagcaccatgtatgtgttcggtggtttcaatagtctcctcctcagcgacatcctggtattcacctcggaacagtgtgatgcgcatcggagtgaagccgcttgtttagcagcaggacctggtattcggtgtgtgtggaacacagggtcgtctcagtgtatctcgtgggcgctggcaactgatgaacaagaagaaaagttaaaatcagaatgtttttccaaaagaactcttgaccatgacagatgtgaccagcacacagattgttacagctgcacagccaacaccaatgactgccactggtgcaatgaccattgtgtccccaggaaccacagctgctcagaaggccagatctccatttttaggtatgagaattgccccaaggataaccccatgtactactgtaacaagaagaccagctgcaggagctgtgccctggaccagaactgccagtgggagccccggaatcaggagtgcattgccctgcccgaaaatatctgtggcattggctggcatttggttggaaactcatgtttgaaaattactactgccaaggagaattatgacaatgctaaattgttctgtaggaaccacaatgcccttttggcttctcttacaacccagaagaaggtagaatttgtccttaagcagctgcgaataatgcagtcatctcagagcatgtccaagctcaccttaaccccatgggtcggccttcggaagatcaatgtgtcctactggtgctgggaagatatgtccccatttacaaatagtttactacagtggatgccgtctgagcccagtgatgctggattctgtggaattttatcagaacccagtactcggggactgaaggctgcaacctgcatcaacccactcaatggtagtgtctgtgaaaggcctgcaaaccacagtgctaagcagtgccggacaccatgtgccttgaggacagcatgtggagattgcaccagcggcagctctgagtgcatgtggtgcagcaacatgaagcagtgtgtggactccaatgcctacgtggcctccttcccttttggccagtgtatggaatggtatacgatgagcacctgcccccctgaaaattgttcaggctactgtacctgtagtcattgcttggagcaaccaggctgtggctggtgtactgatcccagcaatactggcaaagggaaatgcatagagggttcctataaaggaccagtgaagatgccttcgcaagcccctacaggaaatttctatccacagcccctgctcaattccagcatgtgtctagaggacagcagatacaactggtctttcattcactgtccagcttgccaatgcaacggccacagtaaatgcatcaatcagagcatctgtgagaagtgtgagaacctgaccacaggcaagcactgcgagacctgcatatctggcttctacggtgatcccaccaatggagggaaatgtcagccatgcaagtgcaatgggcacgcgtctctgtgcaacaccaacacgggcaagtgcttctgcaccaccaagggcgtcaagggggacgagtgccagctatgtgaggtagaaaatcgataccaaggaaaccctctcagaggaacatgttattatactcttcttattgactatcagttcacctttagtctatcccaggaagatgatcgctattacacagctatcaattttgtggctactcctgacgaacaaaacagggatttggacatgttcatcaatgcctccaagaatttcaacctcaacatcacctgggctgccagtttctcagctggaacccaggctggagaagagatgcctgttgtttcaaaaaccaacattaaggagtacaaagatagtttctctaatgagaagtttgattttcgcaaccacccaaatatcactttctttgtttatgtcagtaatttcacctggcccatcaaaattcaggtgcaaactgaacaatgaggacgcatggacacaggaaggggaacatcacacaccagggcctgttgtggggtggggggaaggggaagggatagcattaggggatatacctaatgttaaatg

SEQ ID NO: 110321 - DNA, 8479 bp, Homo sapiens
  Payload ID: 1648
  Gene Symbol: ATRNL1
  Gene Name: attractin-like 1
  Uniprot ID: Q5VV63
  ENST ID: ENST00000355044
  CDS Start-End: 127-4266
ggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctcatcaaacacttggcttgttccagaaactaaaggagctattgtacaaggtggatatggccatactagtgtgtatgatgaaataacaaagtccatttatgttcatggagggtataaagcattgccagggaacaaatatggattggttgatgatctttataaatatgaagttaacactaagacttggactattttgaaagaaagtgggtttgccagataccttcattcagctgttcttatcaatggagctatgcttatttttggaggaaatacccataatgacacttccttgagtaacggtgcaaaatgtttttctgccgatttcctggcatatgacatagcttgtgatgaatggaaaatactaccaaaaccaaatcttcatagagatgtcaacagatttggacactctgcagtagtcattaacgggtccatgtatatatttgggggattttctagtgtactccttaatgatatccttgtatacaagcctccaaattgcaaggctttcagagatgaagaactttgtaaaaatgctggtccagggataaaatgtgtttggaataaaaatcactgtgaatcttgggaatctgggaatactaataatattcttagagcaaagtgccctcctaaaacagctgcttctgatgacagatgttacagatatgcagattgtgccagctgtactgccaatacaaatgggtgccaatggtgtgatgacaagaaatgcatttcggcaaatagtaactgcagtatgtctgtcaagaactacaccaaatgtcatgtgagaaatgagcagatttgtaacaaacttaccagctgtaaaagctgttcactaaacttgaattgccagtgggatcagagacagcaagaatgccaggctttaccagctcatctttgtggagaaggatggagtcatattggggatgcttgtcttagagtcaattccagtagagaaaactatgacaatgcaaaactttattgctataatcttagtggaaatcttgcttcattaacaacctcaaaagaagtagaatttgttctggatgaaatacagaagtatacacaacagaaagtatcaccttgggtaggcttgcgcaagatcaatatatcctattggggatgggaagacatgtctccttttacaaacacaacactacagtggcttcctggcgaacccaatgattctgggttttgtgcatatctggaaagggctgcagtggcaggcttaaaagctaatccttgtacatctatggcaaatggccttgtctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgccagtgtaatggacatagcacttgcatcaataataatgtgtgcgaacagtgtaaaaatctcaccacaggaaagcagtgtcaagattgtatgccaggttattatggagatccaaccaatggtggacagtgcacagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactttatagcaaacccagaacagtcgaacaaaaatctggatatatcaattaatgcatcaaacaactttaatctcaacattacgtggtctgtcggttcaacagctggaacaatatctggggaagagacttctatagtttccaagaataatataaaggaatacagagatagtttttcctatgaaaaatttaactttagaagcaatcctaacattacattctatgtgtacgtcagcaacttttcctggcctattaaaatacagattgcattctcacaacacaatacaatcatggaccttgtgcagttttttgtcaccttcttcagttgtttcctatccttattgctggtggctgctgtggtatggaagatcaaacaaacttgttgggcttctcgacggagagagcaactgcttcgagaacgacagcagatggccagccgtccctttgcttctgttgatgtagctctggaagtgggagctgaacaaacagagtttctgcgagggccattagagggggcacccaagccaattgccattgaaccatgtgctgggaacagagctgctgttctgactgtgtttctttgtctaccacgaggatcatcaggtgcccctccccctgggcagtcaggccttgcaattgccagtgccctaatagatatttcacaacagaaagcttcagatagtaaagataagacttctggagtccggaatcgaaaacacctttcaacacgtcaaggaacttgtgtctgagaaatggaaaccgctcctgtatattctgtactgttttacttcgggcttctgttaaagctgttctatggccttggattttatggaggcagatctctgtatcatccagagcctgagtacagtttccttccaaatggacaatgacccaggtggccaaagaatgttcatgagttttataaaagtattgatggtcacaggtgataaagtcagtttttaccactatcttaggcttattatagctaacattaaattactctggaaaaagatgtatattgtttcttaatgaagatgaaaaatatgtaattcatataaatcaactgtttatatcccaagacttgaaagaaagacattttttaatgcctgaatgatgagaattgtacagtttttgcctcataagcaaacttgaatcacctgtgtatgaacagggaatgaacacattgcaatggctttaaatgctcttttatctcgttgtaaaggtaaggcaagattttgatgtagtaggatgtaggtaatgtatttaaatatttcatatgaccatatcgtgtccaaactcagtctgagaatgtgacagctttccgcctaactagaatgcagaccagaatgagttcaactcattctgtgcaacttcacagggggtttattagaatgctcagtgtagaggacattcctgtcatccatgccaactacctaactcgttatcagagctgatagagcatggaaaagtctgtccagcgatcagttgttcccctccttccaaaaacagcctccaataccacaacctgaaaagagccgaaatggttattttacagcatacaagcttctgctccagtatgataatttttaattgcctaagaatcattggatcagacctaaatgatccatctgcatttttataagaatggatctttctttgcccttcctctcctagctgctagattttaactaccttttacaaatgttacaaaatgtattttagaggcgacatctctcaagatgacctgagttccttcctgccaactgttccacctagaatacaagtagagaagagcactggctggcaagcatcaacaggagtcttcttcccaacacgagcgcatccatgtcctgagaaaaagtctgtggtttagaaaatatgtccatggttgcccacagtcagcacactcttagtgactcaaaattctgaattatggcagaaaggaaaaataaaacatacttcacattagaacacagaatcatttacatcctaatactgaccacagttcactaaagctcagtagcattaacagatatagtttggaattgcagtttcctcacttcagggtgacaagatatgtataacagtgacagaaatctccaaagctgctgtatatgatatagctttgttaaatatgaaggtcctttaaatacaattgatgtttagtactatatatgtacttttcacattctttggatttctggaaggttatgacactttactgtttacagctaatgcatagttacttgcatgccatggttgtacagtagcagactatgaccctattgtgatattaagtgtttatttcataatgccatttatacatagctgaatttgatgaggattgaatgtcatatataagaggaatgatcatacaatatgtagttgcatcttatataagatttctaggttgcatctaaccatgactatgtcattattttgataattaggcatttatgaattatagtatatattcctcatgttggcatgataattttgctattttccatgcattaaaaataagacaaattcttagagtaattttagtaattttatctataatctgtggggtttttttggagggggaggccactggttgtttctacttccctgtgatattttctctctcattaaaggaatgagctaagtttgtaaatatctcctaaaaacaatcaagtaattttattagcttcttttggaccctctaaatattgacttctctcatgaaaaaataaattgatgaaactaatgattacaaagatataatcattttttaaaaagtgattgcccaatgtatttctctaacaattgtcacaagagaaagcataacaataaaaatacaaaaacatacagatttagatgtaaaatctatataagctatatttttagggaggctaagcagatagtattactgtggaagaattatcaagttttattcacctcaaatcccactgggttcttaaaacttgaaaattcaaattgtagagaattatgagacacaatgtgatgtttagttaaagtcatgctatacctttctgggccacatattgctaactctgtggctaattatgcaattaattctcaacgtatcaaagcttttcactggcagtaaattctttgccctcaggtgaagtggattgaaaagacatcaaggatcaaggataatcactttgaatctgttggtttttccccctacattccagacactttaaatttggatgctttcattttttttaaatcaaaccacacaaatatgcagatactttcccagaatttcgcagttaaatggctgatcctcttgaaaactaaccttaatggaattctaaacatttcagtttagaatgactttgaaaaattccttagatttttaggatgttttattctgccaagtatgaaaaaaaaatggttaaatacaatggagttttaaaaattaacctggggattctatttgaactagaaaattcctattggaaaagaatttgcacatacttacagattcagctaataaattttaagaggattaggattctcataattctttaaatgaaaatttgttttagtgatacacagagatgccgtatactatagtgttatgttcagtaggaaaacttcaaatagttcgtatttaaaaaggtaattgatccttgctgtacttcccaacatctcatcttcttttagctgcagtaagatagaggtgactgtatggctacagttcatggtataaggtcatttagggtgcacactggcacacaggctggaaaacgggcactggacccagctttcaggtgtgtggtgctgggtaagtttcacctttgaagcctcagccttccatctgtaaagggcggtaatggtgcccacctttcgaggcattgcgaggctagatggtaacacacagaaagctcccacagtgggaccttgatgcagcgtagctggtattaacaaccgtggggacaccaggccactctttttctaccagttgttttatgaatccacctattaattttcatccatcttttggtcgtaggtaaaggtcaatcaggtttttcaaaaagactccctgaataacttaagttcctgtatttctaagatatagggatttctacaaaacgactttgacatttagtcaataaagacttaaactcttcttaaatctatagttttaggagagtttttcttaaaattactgactgatgacattgagacaagagcatcaatgatcacctttcacgtacaaactaggcaagacagggtcagtgcttacattttgtggttatacatgatacatcttttctcagtgaacataaaactatgatttgaaaggtgtcttatatttaaaaaagattgtaaaatgaaaactgaccaaatgaactaattctacccacctatggtctttttaaatgtcgagtttcaaaacccatttgccgtatactagagtgagcttggaaacttacctgattacaggaattgcttgggttcaggcagattcccactttcacctctagagatttagattcagaaacactggggtaggccctggagagcagtactcttaacaagctcctcagtgcttcttaccattaggcaaattagggaaacactgcattgggtcaaagtgctgcctttaatcgaccattagagggagttctctaaataacaaagttattactctaattcaaaatgctttaaagaattttccaaggaatacaagccatctggttggtgttagttatagcagtgatttcattagagtgtacatttaacattttagttttatcaaaattttttgaaattaagaattagaaccagagctcctatcagtatatatgtacacaggtgtgcatgccagtgttcaaaagattgtgtaaaagttcaagcccgttttagaaagccaacattttatgttataatatgctgttaatcaggactttattaaataaaaacattggctcttccaacccccac

SEQ ID NO: 110322 - DNA, 932 bp, Homo sapiens
  Payload ID: 1648
  Gene Symbol: ATRNL1
  Gene Name: attractin-like 1
  ENST ID: ENST00000526946
  CDS Start-End: 175-932
cgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgat

SEQ ID NO: 110323 - DNA, 648 bp, Homo sapiens
  Payload ID: 1648
  Gene Symbol: ATRNL1
  Gene Name: attractin-like 1
  ENST ID: ENST00000526373
  CDS Start-End: 1-648
ctgtgaaaaacctgttgttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccctcaaaattgttctggattgagaacctgtggacagtgtttggaacagcctggatgtggctggtgcaatgatcctagtaatacaggaagaggacattgcattgaaggttcttcacggggaccaatgaagcttattggaatgcaccacagtgagatggttcttgacaccaatctttgccccaaagaaaagaactatgagtggtcctttatccagtgtccagcttgtacatgcagtggccatgcaaatatctgtcatctgcacacaggaaaatgtttctgcacaactaaaggaataaaaggtgaccaatgccaattatgtgactctgaaaatcgctatgttggtaatccacttagaggaacatgttattacagccttttgattgattatcaatttaccttcagcttattacaggaagatgatcgccaccatactgccataaactt

SEQ ID NO: 110324 - DNA, 1583 bp, Homo sapiens
  Payload ID: 1648
  Gene Symbol: ATRNL1
  Gene Name: attractin-like 1
  ENST ID: ENST00000527407
  CDS Start-End: 289-1485
cgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaagaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgat

SEQ ID NO: 110325 - DNA, 1818 bp, Homo sapiens
  Payload ID: 1648
  Gene Symbol: ATRNL1
  Gene Name: attractin-like 1
  Uniprot ID: Q5VV63
  ENST ID: ENST00000609571
  CDS Start-End: 387-1790
agttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctggacgggaacagctggctgctgtgctatggcttcctctacctggcgctctacgcgcaggtgtcccagtccaagccgtgcgagaggaccggctcctgcttctcgggccgctgtgtcaactccacctgcctctgcgacccgggctgggtgggggaccagtgccagcactgccagggcaggttcaagttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatgaatttagtcaaaa

SEQ ID NO: 110326 - DNA, 1701 bp, Homo sapiens
  Payload ID: 1648
  Gene Symbol: ATRNL1
  Gene Name: attractin-like 1
  ENST ID: ENST00000616894
  CDS Start-End: 181-291
agttggcgcgggccgcgggcgaggcggggccgcgcgcggggtcccctcctcctgccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccgggatttcgccagggaataaaaatgttcttcaaatgtttcttgaggatagaagattgatagttgggggaagaaatgcagaagcaaatatagtatcaaaagtggtacttcagttctcttagcattgattccagtcttctgtttccatttgaaaagaataaagcactcagaataacaagccattccttccttacacaggttaacagaaccttctggatatttaacagatggcccaattaactataaatataaaactaaatgtacttggctcattgaaggctatccaaatgcagtgttaagattaagattcaatcattttgctacagaatgtagctgggatcatatgtatgtttatgatggagattcaatatatgcacctttaatagctgtacttagtggtttgatagtccctgaaataaggggcaatgaaactgtgcctgaagttgttactacatctggctatgcactgttacatttttttagtgatgctgcgtataatctaactggtttcaacattttctattcaatgtagaaattggtaaccagagaatttttcaccagaaatattataaatatccttgaatcagcaatttattatggaatttatttatcctacaacgtatccaaaatcaattcttgtcctaacaattgctctggtcatgggaagtgtacaactagtgtctctgttccaagtcaagtatattgtgaatgtgataaatactggaagggtgaagcttgtgatattccttactgtaaagccaattgcggcagtccagatcacggttactgtgacctgactggagaaaaattatgtgtctgcaatgatagttggcaaggtcctgattgttctttgaatgttccctctactgagtcttactggattctgccaaacgttaaacccttcagtccttctgtaggtcgggcttcacataaagcagttttacacgggaaatttatgtgggtgattggtggatatacttttaactacagttcttttcaaatggtcctaaattacaatttagaaagcagtatatggaatgtaggaactccatcaaggggacctctccagagatatggacactctcttgctttatatcaggaaaacatctttatgtatggaggcagaattgaaacaaatgatggcaatgtcacagatgaattatgggtttttaacatacatagtcagtcatggagtacaaaaactcctactgttcttggacatggtcagcagtatgctgtggagggacattcagcacatattatggagttggatagtagagatgttgtcatgatcataatatttggatattctgcaatatatggttatacaagcagcatacaggaataccatatctgtgagttacttaaaaattgtaatttctttattgattgggaatgtttttctctttaataaaatcttcatatgaattta

SEQ ID NO: 110327 - DNA, 1240 bp, Homo sapiens
  Payload ID: 1649
  Gene Symbol: ACKR1
  Gene Name: atypical chemokine receptor 1 (Duffy blood group)
  Uniprot ID: Q16570
  ENST ID: ENST00000368121
  CDS Start-End: 176-1192
ggcttccccaggactgttcctgctccggctcttcaggctccctgctttgtccttttccactgtccgcactgcatctgactcctgcagagaccttgttctcccacccgaccttcctctctgtcctcccctcccacctgcccctcaattcccaggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 110328 - DNA, 1740 bp, Homo sapiens
  Payload ID: 1649
  Gene Symbol: ACKR1
  Gene Name: atypical chemokine receptor 1 (Duffy blood group)
  Uniprot ID: Q16570
  ENST ID: ENST00000368122
  CDS Start-End: 680-1690
acacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtgaa

SEQ ID NO: 110329 - DNA, 550 bp, Homo sapiens
  Payload ID: 1649
  Gene Symbol: ACKR1
  Gene Name: atypical chemokine receptor 1 (Duffy blood group)
  ENST ID: ENST00000435307
  CDS Start-End: 86-550
gtcccagcccttctgtctgcgggcctgaaccaaacggtgccatggggaactgtctgcacagggagactcttccggtgtaactctgatggcctcctctgggtatgtcctccaggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctg

SEQ ID NO: 110330 - DNA, 1902 bp, Homo sapiens
  Payload ID: 1649
  Gene Symbol: ACKR1
  Gene Name: atypical chemokine receptor 1 (Duffy blood group)
  Uniprot ID: Q16570
  ENST ID: ENST00000537147
  CDS Start-End: 844-1854
caagggagagaagtgtgttcacttccttttgctaagcccttcctttccagagagtgtcttggggggcatctgactgcttccccccaccctctgccaggcattgctggagaatgttaagacggcgatggagatgccatcaaccccaccctgcagagcatcaccagacacccgccaagcccctcacatacagatatgtgcacaatgatacacagcaaacgtacacagagttcagtacacacaaagagctcacgcccacgtgcacacacccctcagttgggacagagttgaccaccaccacctttctcccaaacacatggcttttgaactgcctttccttggatccagttcaaggggatggaggagcagtgagagtcagccgcccttccactccaatttcccagcacctcccttatctctgcctcacaagtcacccagcccccctctcttccttccttgtgcttgaagaatctctccttgctggaaagccccctgttttctcaatctccctttccacttcggtaaaatctctacttgctggaaagccccctgttttctcaatctccctttccacttcggtaaaatgcccactttctggtccccacctttttcctgagtgtagtcccaaccagccaaatccaacctcaaaacaggaagacccaaggccagtgacccccataggcctgaggcttgtgcaggcagtgggcgtggggtaaggcttcctgatgccccctgtccctgcccagaacctgatggccctcattagtccttggctcttatcttggaagcacaggcgctgacagccgtcccagcccttctgtctgcgggcctgaaccaaacggtgccatggggaactgtctgcacagggcggagctctccccctcaactgagaactcaagtcagctggacttcgaagatgtatggaattcttcctatggtgtgaatgattccttcccagatggagactatggtgccaacctggaagcagctgccccctgccactcctgtaacctgctggatgactctgcactgcccttcttcatcctcaccagtgtcctgggtatcctagctagcagcactgtcctcttcatgcttttcagacctctcttccgctggcagctctgccctggctggcctgtcctggcacagctggctgtgggcagtgccctcttcagcattgtggtgcccgtcttggccccagggctaggtagcactcgcagctctgccctgtgtagcctgggctactgtgtctggtatggctcagcctttgcccaggctttgctgctagggtgccatgcctccctgggccacagactgggtgcaggccaggtcccaggcctcaccctggggctcactgtgggaatttggggagtggctgccctactgacactgcctgtcaccctggccagtggtgcttctggtggactctgcaccctgatatacagcacggagctgaaggctttgcaggccacacacactgtagcctgtcttgccatctttgtcttgttgccattgggtttgtttggagccaaggggctgaagaaggcattgggtatggggccaggcccctggatgaatatcctgtgggcctggtttattttctggtggcctcatggggtggttctaggactggatttcctggtgaggtccaagctgttgctgttgtcaacatgtctggcccagcaggctctggacctgctgctgaacctggcagaagccctggcaattttgcactgtgtggctacgcccctgctcctcgccctattctgccaccaggccacccgcaccctcttgccctctctgcccctccctgaaggatggtcttctcatctggacacccttggaagcaaatcctagttctcttcccacctgtcaacctgaattaaagtctacactgcctttgtg

SEQ ID NO: 110331 - DNA, 2879 bp, Homo sapiens
  Payload ID: 1650
  Gene Symbol: ACKR2
  Gene Name: atypical chemokine receptor 2
  Uniprot ID: O00590
  ENST ID: ENST00000442925
  CDS Start-End: 99-1253
ggatacagtacgggatcctttctggaatggaggtcttatgagctgctattgaacacggcagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatca

SEQ ID NO: 110332 - DNA, 2956 bp, Homo sapiens
  Payload ID: 1650
  Gene Symbol: ACKR2
  Gene Name: atypical chemokine receptor 2
  Uniprot ID: O00590
  ENST ID: ENST00000422265
  CDS Start-End: 176-1330
acagtacgggatcctttctggaatggaggtcttatgagctgctattgaacacggcagagcctgttggtgacctgcacacaggagccctccagtcagtactgattgaattactcaaggctgcctctctgcaaagttgagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtattggttgtgtcttggtgaggctgaggcccgcaggccagggccgggctttaaaaatagctgcagccttggtggtggccttcttcgtgctatggttcccatacaatctcaccttgtttctgcatacgctgttggacctgcaagtattcgggaactgtgaggtcagccagcatctagactacgcactccaggtaacagagagcatcgccttccttcactgctgcttttcccccatcctgtatgccttctccagtcaccgcttccgccagtacctgaaggctttcctggctgccgtgcttggatggcacctggcacctggcactgcccaggcctcattatccagctgttctgagagcagcatacttactgcccaagaggaaatgactggcatgaatgaccttggagagaggcagtctgagaactaccctaacaaggaggatgtggggaataaatcagcctgagtgaccaaattttggtctggtgggaacagatgggaaccagctcaattgggtgtccactcaaagtgctctctccaggggcctcagtgactgtgttgctaaacccagtggtcagttctcagttctcagccatcagcagcatttgctcgccccgccttcttcctccactttcttcacttgcttccaggataccacgctttcttttctgaattgctacaatctttcttccttccttccttgcttccttccttccttccttccctctctccctccctccctccctcgcttcttcccttcctcctttcctcccttcctactttccttccttccttctgacagggtcttgctctattgctctgtcacccaggctggaatgcagtggcgagatctccgctcactgtagcctcctccccctgggttgaagcaattctcatgcctcagcctcccaagtagccaggactataggcacctgccaccatgcctggctaatttttgtattttttttctttctttctttcttttcttttttttttttttttgagacggagtctcactcttgttgcccaggctggacaacaatggcgcgatctcggctcactgcaacctccacctcccggattcaagcgattctcctgcctcagcctcctgagtagctggaactacatgcgcgtgccaccacgcacagctaatttttataattttagtagagatggggtttcactgcgttggccaggatgatctcgatctcttgaccttgggatccacccgccttggcctcccaaagtgctgggattacaggtgtgagccaccatgcctggccctaatttttgtgtttttattagaaacagagtttcaccatgttggccaggctggagaattgctgtaatagttttccaactggcccctgtccttcctctctcttgctctcctcccatctcatctgcacctagcagccagagtgatcctgatactctcggcctttacttccgcctccctcagagcagcagcctgtcaaaacaccagattacaacaaatttagtttaaaggtctcaattagcgttattggcaattctagaatcaggcaacagactcattgaatcaggaacagattcactccataaaatacagagagtgctgcaatgagctgggtagaagaggttagttttatagacaggaaggggctgtcaaaggcagaaagaaatgaagaacaaaaaaaaagattgatttttttttttttgagacaggatctcactctgtcatccaggctgaagtccaatcccacaatcatggctcactgcagccaccacctcctgagctcaagtgatcctcccatctaagcccccaagtagctaggactacaggagcacaccaccacacctggctaatttttgtattttttgtggagacagggtctcagtatgttacccaggttggactggaaacccttggctcaagcaatttgcctgcctcagcctcccaaagtgctgggattacaggcgtgagccactgcacagggccagattcatcatttcaaagttactttctatatgcggccggaacagggtggttgacatcagttttcttcaggttactttttaataatgattaaaacggggaacttcattatca

SEQ ID NO: 110333 - DNA, 878 bp, Homo sapiens
  Payload ID: 1650
  Gene Symbol: ACKR2
  Gene Name: atypical chemokine receptor 2
  ENST ID: ENST00000493193
  CDS Start-End: 180-878
cttctgcagcagctcacaggctcccagcaccagccatgtgctaggagtgtccttactgctgcccagaaaagggaggagttgaaggccaggaggcccctggtgcagaggagaggacaggaagaccagcagaaaaaggcactggcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctgtgtccctggccgtctccatccctgatatggtctttgtacagacacatgaaaatcccaagggtgtgtggaactgccacgcagatttcggcgggcatgggaccatttggaagctcttcctccgcttccagcagaacctcctagggtttctccttccactccttgccatgatcttcttctactcccgtatt

SEQ ID NO: 110334 - DNA, 719 bp, Homo sapiens
  Payload ID: 1650
  Gene Symbol: ACKR2
  Gene Name: atypical chemokine receptor 2
  ENST ID: ENST00000497921
  CDS Start-End: 346-719
tctggaatggaggtcttatgagctgctattgaacacggcagagcctgttggtgacctgcacacaggagccctccagtcagtactgattgaattactcaaggctgcctctctgcaaagttgaggtagctcatggtgctcccttccttggtgcagacgggcagttcaaaccacacaaactccagcctgtgggagagggatccttcatcctggacgcacctgccctctgcccagccactataaaaaccagagccacgtgccccttcttttgcttgagtgtgggccctgctgtccccagaaagcctcattaccactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatac

SEQ ID NO: 110335 - DNA, 797 bp, Homo sapiens
  Payload ID: 1650
  Gene Symbol: ACKR2
  Gene Name: atypical chemokine receptor 2
  ENST ID: ENST00000494619
  CDS Start-End: 287-797
gtttagaattggggcagaatgggactgagatcttgctgagaaggtatccaggatgaagaagctgaaggtgatgttgggaaggcccttcagttgaaagcaggatatacataggctgctgtccagagaggggatgagcgcatggaaaggaattacactctgtctgcacttccctgaggaagaggcacctggcgctgccgctctcctcccaggcttgtggtggacattctcaagcaagtcattctggctccgcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagtacctggagatcgttcatgctcagccctaccacaggctgaggacccgggccaagagcctgctccttgctaccatagtatgggctg

SEQ ID NO: 110336 - DNA, 567 bp, Homo sapiens
  Payload ID: 1650
  Gene Symbol: ACKR2
  Gene Name: atypical chemokine receptor 2
  ENST ID: ENST00000492609
  CDS Start-End: 140-567
attcctggagccgcctccctgttgtcccacctctacctctccgggaacccgctgtgctgtgggacaggaggagacctagcggacagcctttggataaagcagcactacaggacgtcgggactgggcatttccttccaacatggccgccactgcctctccgcagccactcgccactgaggatgccgattctgagaatagcagcttctattactatgactacctggatgaagtggccttcatgctctgcaggaaggatgcagtggtgtcctttggcaaagtcttcctcccagtcttctatagcctgatttttgtgttgggcctcagcgggaacctccttcttctcatggtcttgctccgttacgtgcctcgcaggcggatggttgagatctatctgctgaatctggccatctccaaccttctgtttctggtgacactgcccttctggggcatctccgtggcctggcattgggtcttcgggagtttcttgtgcaagatggtgagcactctttatactattaacttttacagtggcatctttttcattagctgcatgagcctggacaagta

SEQ ID NO: 110337 - DNA, 2203 bp, Homo sapiens
  Payload ID: 1651
  Gene Symbol: ACKR3
  Gene Name: atypical chemokine receptor 3
  Uniprot ID: P25106
  ENST ID: ENST00000272928
  CDS Start-End: 311-1399
acacttgtgcaggaaacaacagactagtgaggtttacaagaggggggtgtgtgtgtgtgtgtgtctgcctgtgggatgggggtggcacgggggagagagagatgtgggttacaaagctgccatctagaggctagaggctcctttctgcagtgtatataatgcaagtctgcagccagcagagctcacagttgttgcaaagtgctcagcactaagggagccagcgcacagcacagccaggaaggcgagcgagcccagccagcccagccagcccagccagcccggaggtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcggcatggagctggtctccgttgtcttgggctttgccgttcccttctccattatcgctgtcttctacttcctgctggccagagccatctcggcgtccagtgaccaggagaagcacagcagccggaagatcatcttctcctacgtggtggtcttccttgtctgctggctgccctaccacgtggcggtgctgctggacatcttctccatcctgcactacatccctttcacctgccggctggagcacgccctcttcacggccctgcatgtcacacagtgcctgtcgctggtgcactgctgcgtcaaccctgtcctctacagcttcatcaatcgcaactacaggtacgagctgatgaaggccttcatcttcaagtactcggccaaaacagggctcaccaagctcatcgatgcctccagagtctcagagacggagtactctgccttggagcagagcaccaaatgatctgccctggagaggctctgggacgggtttacttgtttttgaacagggtgatgggccctatggttttctagagcaaagcaaagtagcttcgggtcttgatgcttgagtagagtgaagaggggagcacgtgccccctgcatccattctctctttctcttgatgacgcagctgtcatttggctgtgcgtgctgacagttttgcaacaggcagagctgtgtcgcacagcagtgctgtgcgtcagagccagctgaggacaggcttgcctggacttctgtaagataggattttctgtgtttcctgaattttttatatggtgatttgtatttaaattttaagactttattttctcactattggtgtaccttataaatgtatttgaaagttaaatatattttaaatattgtttgggaggcatagtgctgacatatattcagagtgttgtagttttaaggttagcgtgacttcagttttgactaaggatgacactaattgttagctgttttgaaattatatatatataaatatatataaatatataaatatatgccagtcttggctgaaatgttttatttaccatagttttatatctgtgtggtgttttgtaccggcacgggatatggaacgaaaactgctttgtaatgcagtttgtgacattaatagtattgtaaagttacattttaaaataaacaaaaaactgttctggactgcaaatctgcacacacaacgaacagttgcatttcagagagttctctcaatttgtaagttatttttttttaataaagatttttgtttcctaaaaatgca

SEQ ID NO: 110338 - DNA, 713 bp, Homo sapiens
  Payload ID: 1651
  Gene Symbol: ACKR3
  Gene Name: atypical chemokine receptor 3
  ENST ID: ENST00000447924
  CDS Start-End: 82-713
ggtgaccccggggccagaattctcgcaggcgcctgggccgggtgcccggccgtgcgtcatttgattgcccgcctcagaacgatggatctgcatctcttcgactactcagagccagggaacttctcggacatcagctggccatgcaacagcagcgactgcatcgtggtggacacggtgatgtgtcccaacatgcccaacaaaagcgtcctgctctacacgctctccttcatttacattttcatcttcgtcatcggcatgattgccaactccgtggtggtctgggtgaatatccaggccaagaccacaggctatgacacgcactgctacatcttgaacctggccattgccgacctgtgggttgtcctcaccatcccagtctgggtggtcagtctcgtgcagcacaaccagtggcccatgggcgagctcacgtgcaaagtcacacacctcatcttctccatcaacctcttcggcagcattttcttcctcacgtgcatgagcgtggaccgctacctctccatcacctacttcaccaacacccccagcagcaggaagaagatggtacgccgtgtcgtctgcatcctggtgtggctgctggccttctgcgtgtctctgcctgacacctactacctgaagaccgtcacgtctgcgtccaacaatgagacctactgccggtccttctaccccgagcacagcatcaaggagtggctgatcgg

SEQ ID NO: 110339 - DNA, 1914 bp, Homo sapiens
  Payload ID: 1652
  Gene Symbol: ACKR4
  Gene Name: atypical chemokine receptor 4
  Uniprot ID: Q9NPB9
  ENST ID: ENST00000249887
  CDS Start-End: 97-1149
gtaaagtgaaaacaaaagtagctggagttaggtcatttgattttatactctgtactcaagactgctcctctctgccgactacaacagattggagccatggctttggaacagaaccagtcaacagattattattatgaggaaaatgaaatgaatggcacttatgactacagtcaatatgaactgatctgtatcaaagaagatgtcagagaatttgcaaaagttttcctccctgtattcctcacaatagttttcgtcattggacttgcaggcaattccatggtagtggcaatttatgcctattacaagaaacagagaaccaaaacagatgtgtacatcctgaatttggctgtagcagatttactccttctattcactctgcctttttgggctgttaatgcagttcatgggtgggttttagggaaaataatgtgcaaaataacttcagccttgtacacactaaactttgtctctggaatgcagtttctggcttgtatcagcatagacagatatgtggcagtaactaaagtccccagccaatcaggagtgggaaaaccatgctggatcatctgtttctgtgtctggatggctgccatcttgctgagcataccccagctggttttttatacagtaaatgacaatgctaggtgcattcccattttcccccgctacctaggaacatcaatgaaagcattgattcaaatgctagagatctgcattggatttgtagtaccctttcttattatgggggtgtgctactttatcacagcaaggacactcatgaagatgccaaacattaaaatatctcgacccctaaaagttctgctcacagtcgttatagttttcattgtcactcaactgccttataacattgtcaagttctgccgagccatagacatcatctactccctgatcaccagctgcaacatgagcaaacgcatggacatcgccatccaagtcacagaaagcatcgcactctttcacagctgcctcaacccaatcctttatgtttttatgggagcatctttcaaaaactacgttatgaaagtggccaagaaatatgggtcctggagaagacagagacaaagtgtggaggagtttccttttgattctgagggtcctacagagccaaccagtacttttagcatttaaaggtaaaactgctctgccttttgcttggatacatatgaatgatgctttcccctcaaataaaacatctgcattattctgaaactcaaatctcagacgccgtggttgcaacttataataaagaatgggttgggggaagggggagaaataaaagccaagaagaggaaacaagataataaatgtacaaaacatgaaaattaaaatgaacaatataggaaaataattgtaacaggcataagtgaataacactctgctgtaacgaagaagagctttgtggtgataattttgtatcttggttgcagtggtgcttatacaaatctacacaagtgataaaatgacacagaactatatacacacattgtaccaatttcaatttcctggttttgacattatagtataattatgtaagatggaaccattggggaaaactgggtgaagggtacccaggaccactctgtaccatctttgtaacttcctgtgaatttataataatttcaaaataaaacaagttaaaaaaaaacccactatgctataagttaggccatctaaaacagattattaaagaggttcatgttaaaaggcatttataattatttttaattatctaagttttaatacaagaacgatttccctgcataattttagtacttgaataagtatgcagcagaactccaactatcttttttcctgttttttttaaatttgtaagtaattttataaaatccacctcctccaaaaaagcaataaaaaaaaaacaaactataataa

SEQ ID NO: 110340 - DNA, 424 bp, Homo sapiens
  Payload ID: 1652
  Gene Symbol: ACKR4
  Gene Name: atypical chemokine receptor 4
  ENST ID: ENST00000509820
  CDS Start-End: 1-63
gtggaggagtttccttttgattctgagggtcctacagagccaaccagtacttttagcatttaaagctcatccataataactccgggacgactgactacacaaggagagaatggtgattggcatttacctgtcatacagaagcaagagcaatcaaggcatagtccacgtggctgagtccgctgacagctggcaaaaacaagttccagagaccctcgactttggccatttcctgtcaaggtgatgaacatgccagagtgaccataatttaccaggactcacagtagtttatttctttttttaaatattggtatttatgatctttgaaatttaaaaacacttatggagttatttattttactgtattctccagtgagcaaaaccaagttcttattaattcattataaatcaacagtttaaccattaa

SEQ ID NO: 110341 - DNA, 1490 bp, Homo sapiens
  Payload ID: 1653
  Gene Symbol: AUH
  Gene Name: AU RNA binding protein/enoyl-CoA hydratase
  Uniprot ID: Q13825
  ENST ID: ENST00000303617
  CDS Start-End: 25-957
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 110342 - DNA, 1577 bp, Homo sapiens
  Payload ID: 1653
  Gene Symbol: AUH
  Gene Name: AU RNA binding protein/enoyl-CoA hydratase
  Uniprot ID: Q13825
  ENST ID: ENST00000375731
  CDS Start-End: 25-1044
aggtccacgccgtaaacagacaacatggcggccgcggtggcggcggcacctggggccttgggatccctgcatgctggcggcgcccgcctggtggccgcttgcagtgcgtggctctgcccggggttgaggctgcccggctcgttggcaggccggcgagcgggcccggcgatctgggcccagggctgggtacctgcggccgggggtcccgccccgaaaaggggctacagctctgagatgaagacggaggacgagctgcgggtgcggcacctggaggaggagaaccgaggaattgtggtgcttggaataaacagagcttatggcaaaaattcactcagtaaaaatcttataaaaatgctatcaaaagctgtggatgctttgaaatctgataagaaagtacggaccataataatcaggagtgaagtcccagggatattctgtgctggtgctgaccttaaggaaagagccaaaatgagttccagtgaagttggtccttttgtctccaaaataagagcagtgattaacgatattgctaatcttccagtaccaacaattgcagcaatagatggactcgctttaggtggtggtcttgaactggctttagcctgtgatatacgagtagcagcttcctctgcaaaaatgggcctggttgaaacaaaattggcgattattcctggtggaggggggacacagcgattgccacgcgccattggaatgtccctggccaaggagctcatattctctgcgcgagtcctcgatggcaaagaagccaaagcagtgggcttaatcagccacgttctggaacagaaccaggagggagacgcggcctacaggaaggccttggacctggcgagagagtttttacctcagggacctgttgcaatgagagtggcaaaattagcaattaatcaagggatggaggtcgatttagtaacagggttagccatagaagaagcttgttatgctcagaccattccaacaaaagacagacttgaaggtcttcttgcttttaaagagaaaaggccccctcgctataaaggagaataaaaggaacagaaattcttaagatgccaatgtaataaatgtacttcctggaagtgtctttcggatccactatatgcctcagcacatggaaccttaatgaccaaagtgaagagcagattattcatacggtgtaataagcatctggaatggacccatccgtgtacttcattcaaatgtgtaaatgtcatattcattcagatttataaagctagtagtgtatagtcagaaacagaatcaaagttagatatacatttttaaatatttactgcatatgaggctttctgttaattttttaatgtgaataatttatatattgcacattctagggaataatattgattgtatgtctactgtgctgcattaagaaaataaaatttctatataccaaaaatgtgaagttataccaaataaagtttctaagtgattaatgcatacgaacagctacatatacatatatctaaacctgaaaaatgaattgatattctgagtgaaaactacctaatataaataaaattagtgaaaagaaaacatgggaa

SEQ ID NO: 110343 - DNA, 2248 bp, Homo sapiens
  Payload ID: 1654
  Gene Symbol: AURKA
  Gene Name: aurora kinase A
  Uniprot ID: O14965
  ENST ID: ENST00000347343
  CDS Start-End: 269-1480
ggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110344 - DNA, 2223 bp, Homo sapiens
  Payload ID: 1654
  Gene Symbol: AURKA
  Gene Name: aurora kinase A
  Uniprot ID: O14965
  ENST ID: ENST00000312783
  CDS Start-End: 244-1455
acaaggcagcctcgctcgagcgcaggccaatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110345 - DNA, 2112 bp, Homo sapiens
  Payload ID: 1654
  Gene Symbol: AURKA
  Gene Name: aurora kinase A
  Uniprot ID: O14965
  ENST ID: ENST00000371356
  CDS Start-End: 133-1344
cttggaagacttgggtccttgggtcgcaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110346 - DNA, 1902 bp, Homo sapiens
  Payload ID: 1654
  Gene Symbol: AURKA
  Gene Name: aurora kinase A
  ENST ID: ENST00000395907
  CDS Start-End: 54-1097
gaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggtaagacgcaactgaaaaggacccagcacatctgctggaattctttccttatcagcctgaactgcaggccaagatccgaacatctatactatttgatctctctaacctgtgttttgtgatattttatcatttgttgtactccaggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacaga

SEQ ID NO: 110347 - DNA, 2145 bp, Homo sapiens
  Payload ID: 1654
  Gene Symbol: AURKA
  Gene Name: aurora kinase A
  Uniprot ID: O14965
  ENST ID: ENST00000395911
  CDS Start-End: 166-1377
gaattctaacggctgagctcttggaagacttgggtccttgggtcgcaggtgggagccgacgggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110348 - DNA, 2169 bp, Homo sapiens
  Payload ID: 1654
  Gene Symbol: AURKA
  Gene Name: aurora kinase A
  Uniprot ID: O14965
  ENST ID: ENST00000395913
  CDS Start-End: 190-1401
cttaaacgcgactcaaggcgtcgggtttgttgtcaaccaatcacaaggcagcctcgctcgagcgcaggccaatcggctttctagctagagggtttaactcctatttaaaaagaagaacctttgaattctaacggctgagctcttggaagacttgggtccttgggtcgcaggtgggagccgacgggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110349 - DNA, 2238 bp, Homo sapiens
  Payload ID: 1654
  Gene Symbol: AURKA
  Gene Name: aurora kinase A
  Uniprot ID: O14965
  ENST ID: ENST00000395914
  CDS Start-End: 258-1469
acaaggcagcctcgctcgagcgcaggccaatcggctttctagctagagggtttaactcctatttaaaaagaagaacctttgaattctaacggctgagctcttggaagacttgggtccttgggtcgcaggtgggagccgacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtct

SEQ ID NO: 110350 - DNA, 2114 bp, Homo sapiens
  Payload ID: 1654
  Gene Symbol: AURKA
  Gene Name: aurora kinase A
  Uniprot ID: O14965
  ENST ID: ENST00000395915
  CDS Start-End: 135-1346
cacaaggcagcctcgctcgagcgcaggccaatcggctttctagctagagggtttaactcctatttaaaaagaagaacctttgaattctaacggctgagctcttggaagacttgggtccttgggtcgcaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtc

SEQ ID NO: 110351 - DNA, 879 bp, Homo sapiens
  Payload ID: 1654
  Gene Symbol: AURKA
  Gene Name: aurora kinase A
  ENST ID: ENST00000420474
  CDS Start-End: 314-879
aatcggctttctagctagagggtttaactcctatttaaaaagaagaacctttgaattctaacggctgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcg

SEQ ID NO: 110352 - DNA, 991 bp, Homo sapiens
  Payload ID: 1654
  Gene Symbol: AURKA
  Gene Name: aurora kinase A
  ENST ID: ENST00000441357
  CDS Start-End: 178-991
gaattctaacggctgagctcttggaagacttgggtccttgggtcgcaggtgggagccgacggggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaa

SEQ ID NO: 110353 - DNA, 584 bp, Homo sapiens
  Payload ID: 1654
  Gene Symbol: AURKA
  Gene Name: aurora kinase A
  ENST ID: ENST00000451915
  CDS Start-End: 346-584
tgagctcttggaagacttgggtccttgggtcgcagggtctcactccattgcccaggccagagtgcggggatatttgataagaaacttcagtgaaggccgggcgcggtggctcatgcccgtaatcccagcattttcggaggccgagcaggtatgccagtaggctgcacagggatggaagtgatccattagaggagagatgatggagcagcaagaccatcaggagtgaagactccgtgacagaggatgggacgcagtgcccaaggggaggttggccttgcagggaaagcacatgcctgtccctccctcattagcttcatttggacaaaacatgtaaaatccggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgca

SEQ ID NO: 110354 - DNA, 744 bp, Homo sapiens
  Payload ID: 1654
  Gene Symbol: AURKA
  Gene Name: aurora kinase A
  ENST ID: ENST00000422322
  CDS Start-End: 305-744
ctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgt

SEQ ID NO: 110355 - DNA, 810 bp, Homo sapiens
  Payload ID: 1654
  Gene Symbol: AURKA
  Gene Name: aurora kinase A
  ENST ID: ENST00000456249
  CDS Start-End: 492-810
cctttgaattctaacggctgagctcttggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagagggtctcactccattgcccaggccagagtgcggggatatttgataagaaacttcagtgaaggccgggcgcggtggctcatgcccgtaatcccagcattttcggaggccgaggctggagtgcaatggtgtgatctcagctcactgcaacctctgcttcctgggtttaagtgattctcctgcctcagcctcccgagtagctgggattacaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcattcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctg

SEQ ID NO: 110356 - DNA, 2116 bp, Homo sapiens
  Payload ID: 1655
  Gene Symbol: AUNIP
  Gene Name: aurora kinase A and ninein interacting protein
  Uniprot ID: Q9H7T9
  ENST ID: ENST00000374298
  CDS Start-End: 56-1129
ctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaaggtaatcaagttatcagacaccaattctaaatgtttgaagctttgtttctaaaagtaccttgaaatgatagagatgtaggaaaatatagttgtgggtggagagaggagtgagtttgtttaggtgggaaggtggcatgggatgaagttgtcattactgagcatcttctctgtgtaaataaagggcagtaccattgttaagacagtgggattggcatcatggctttccctcaggaaggtggtggctggtaaattccctgaatgagtctatgatgaacactgaggcagcacagtgggtatttatctctatgaaagtgccttttactcagcctgcacagagccatctctttgcccttccagatgtctgactgggaccttgcttatggatgtgtttttttttttttttttttgagatggagtctcgctctgttgccaggctggagtgcagtggtgcgacctcagctcactgcaccctctgtctcccggattcaagcgattctcctgcctcagcctcccgaatagcagggactacaggcatgcgccaccacgcccagctaattttttttggatttttagtagagacgaggtttcaccatattagccaggatggtctccatctcctgacctcctgatccgcccacctcagcctcccaaagtgctgagattacaggcataagccaccgcgcccagccagatgtgtgagcttttaatctctggctgatcttaacccacatcagcctaagcttgggatgattactcttgacccttttttttcagtgattagcaaatctccccacaacccaggtgtggagagaagagaggtagaatggtgctagtttcctattttatttttgtggtaactgtacagcactttaaagttatatactctatgtttaaatatctcccttaaaaagcctgagctgtacaacaatctggatgtgactctgttacccttttcccacaagataggagggaatcccctttgtaaaactatgaatccaaataaatgtttacaaagtg

SEQ ID NO: 110357 - DNA, 1392 bp, Homo sapiens
  Payload ID: 1655
  Gene Symbol: AUNIP
  Gene Name: aurora kinase A and ninein interacting protein
  Uniprot ID: Q9H7T9
  ENST ID: ENST00000538789
  CDS Start-End: 102-1217
cgttggcgcgagatccgaacgtcggcggccgcggttctggcgttccctgaggcgccgggagcctgcgccggcgtcctgccggcttcgtctcctcagcggccatgaggcggacaggccccgaggaggaggcctgcggcgtgtggctggacgcggcggcgctgaagaggcggaaagtgcagacacatttaatcaaaccaggcaccaaaatgctaacactccttcctggagaaagaaaggctaatatttattttactcaaagaagagctccatctacaggcattcaccagagaagcattgcttccttcttcaccttgcagccaggaaagacaaatggcagtgaccagaagagtgtttcatctcatacagaaagtcagatcaacaaagagtccaagaaaaatgcgacccagctagaccatttgatcccaggcttagcacacgattgcatggcatcccctttagccacttcaaccactgcagacatccaggaagctggactctctcctcagtccctccagacttctggccaccacagaatgaaaaccccattttcaactgagctatctttgctccagcctgatactccagactgtgctggagatagtcataccccactggctttttccttcaccgaggacttggaaagttcttgtttgctagaccgaaaggaagaaaaaggggattctgccaggaaatgggaatggcttcatgagtctaagaagaactatcagagtatggagaaacacaccaaactacctggggacaaatgctgtcagcccttaggcaagactaaattggaaagaaaggtgtctgccaaagaaaacaggcaggcccctgtcctccttcaaacatacagggaatcctggaatggagaaaacatagaatcagtgaaacaaagccgtagtccagtttctgtgttttcctgggacaatgaaaagaatgacaaggactcctggagtcaacttttcactgaagattctcaaggccagcgggtcattgcccacaacactagagctccttttcaagatgtaaccaataactggaattgggacttagggccgtttcctaacagtccttgggctcagtgccaggaggatgggccaactcaaaatctgaagcctgatttgctctttacccaggactctgaagtccaagctctagcttgtcagcaagactgttgcagaagatctatccttaagaggcagaaacatctgcggtgaggaaggcagctattgaaggtattccaggagcatgagactgagtttgcagagctgagggttgtcaatttccttttctactgatatcttcttcctttagagcaaacttcctccttaggacctcagagataagcacagcagggtcttcctccttcaataaactccggttcctagagac

SEQ ID NO: 110358 - DNA, 798 bp, Homo sapiens
  Payload ID: 1656
  Gene Symbol: AURKAIP1
  Gene Name: aurora kinase A interacting protein 1
  Uniprot ID: Q9NWT8
  ENST ID: ENST00000321751
  CDS Start-End: 130-729
tttgagccgcgtcgaggtcgggcttgggaagggtcagcgggaggcctgagggcgccgggcgctgcggcaggcgggcccggggtccagccgagaggctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagcct

SEQ ID NO: 110359 - DNA, 1047 bp, Homo sapiens
  Payload ID: 1656
  Gene Symbol: AURKAIP1
  Gene Name: aurora kinase A interacting protein 1
  Uniprot ID: Q9NWT8
  ENST ID: ENST00000338338
  CDS Start-End: 377-976
ggaatccggcccctgggtggtccggaaacgattctggacctgcgggtatatccagggcccgcaccccctgggattgtgggaaatgtagttttttgcctccgtaagggaccaggcggagctgaggaaccgcgcgaggactgggaccgtgattccactaaccggaaaccgtcgcctttcgggcccggcggggcctgagccaatgcagaatcgggggccgcgaggacgccagcgggcgctgtgcgtaggaaccgccgggtggccgctgccgatcggggccgacttggggacggaccggaagtgcccgagggcggccgcagaacggtcaatttgagccgcgtcgagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 110360 - DNA, 1072 bp, Homo sapiens
  Payload ID: 1656
  Gene Symbol: AURKAIP1
  Gene Name: aurora kinase A interacting protein 1
  Uniprot ID: Q9NWT8
  ENST ID: ENST00000338370
  CDS Start-End: 402-1001
cgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcggtgcgtccgagcgcgacaccgcccgcgtcgggggcttgggagcctcggggcgcgagctgtgttggaagcaaagtcctccttgtgggttggggtggcggagggagaagggaagcgagggtcgcggcgggaccagacgccccagtcccggcccgcccgcgactactgaaggcgctgccgcctgacctgaacgggcacttgtgttccagctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactcagccttt

SEQ ID NO: 110361 - DNA, 875 bp, Homo sapiens
  Payload ID: 1656
  Gene Symbol: AURKAIP1
  Gene Name: aurora kinase A interacting protein 1
  Uniprot ID: Q9NWT8
  ENST ID: ENST00000378853
  CDS Start-End: 212-811
tcaatttgagccgcgtcgaggtcgggcttgggaagggtcagcgggaggcctgagggcgccgggcgctgcggcaggcgggcccggggtccagccgagagggtccgggcgccaggcaacgcgattcgcgcgggggtgaacccggggagggggccggcctccccgttctgggacctttcgctcccctgggacctgtggccgccgcccacagaccatgctcctggggcgcctgacttcccagctgttgagggccgttccttgggcaggcggccgcccgccttggcccgtctctggagtgctgggcagccgggtctgcgggcccctttacagcacatcgccggccggcccaggtagggcggcctctctccctcgcaagggggcccagctggagctggaggagatgctggtccccaggaagatgtccgtcagccccctggagagctggctcacggcccgctgcttcctgcccagactggataccgggaccgcagggactgtggctccaccgcaatcctaccagtgtccgcccagccagataggggaaggggccgagcagggggatgaaggcgtcgcggatgcgcctcaaattcagtgcaaaaacgtgctgaagatccgccggcggaagatgaaccaccacaagtaccggaagctggtgaagaagacgcggttcctgcggaggaaggtccaggagggacgcctgagacgcaagcagatcaagttcgagaaagacctgaggcgcatctggctgaaggcggggctaaaggaagcccccgaaggctggcagacccccaagatctacctgcggggcaaatgagtctggcgccgcccttcccgcccgttgctgctgtgatccgtagtaataaattctcagaggactc

SEQ ID NO: 110362 - DNA, 1254 bp, Homo sapiens
  Payload ID: 1657
  Gene Symbol: AURKB
  Gene Name: aurora kinase B
  Uniprot ID: Q96GD4
  ENST ID: ENST00000316199
  CDS Start-End: 79-1116
cagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaaccaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcat

SEQ ID NO: 110363 - DNA, 1167 bp, Homo sapiens
  Payload ID: 1657
  Gene Symbol: AURKB
  Gene Name: aurora kinase B
  Uniprot ID: Q96GD4
  ENST ID: ENST00000534871
  CDS Start-End: 128-1039
agattcagttgtttgcgggcggccgggagagtagcagtgccttggaccccaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagcttt

SEQ ID NO: 110364 - DNA, 746 bp, Homo sapiens
  Payload ID: 1657
  Gene Symbol: AURKB
  Gene Name: aurora kinase B
  ENST ID: ENST00000580998
  CDS Start-End: 24-395
ctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaagatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgct

SEQ ID NO: 110365 - DNA, 397 bp, Homo sapiens
  Payload ID: 1657
  Gene Symbol: AURKB
  Gene Name: aurora kinase B
  ENST ID: ENST00000583915
  CDS Start-End: 189-397
agattcagttgtttgcgggcggccgggagagtagcagtgccttggaccccagcacattccaccccggtcatcagacaaaggcaccctcagagctaccccctgctccttctcaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtc

SEQ ID NO: 110366 - DNA, 939 bp, Homo sapiens
  Payload ID: 1657
  Gene Symbol: AURKB
  Gene Name: aurora kinase B
  Uniprot ID: Q96GD4
  ENST ID: ENST00000578549
  CDS Start-End: 1-939
atggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctga

SEQ ID NO: 110367 - DNA, 739 bp, Homo sapiens
  Payload ID: 1657
  Gene Symbol: AURKB
  Gene Name: aurora kinase B
  ENST ID: ENST00000584972
  CDS Start-End: 1-727
gcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtca

SEQ ID NO: 110368 - DNA, 742 bp, Homo sapiens
  Payload ID: 1657
  Gene Symbol: AURKB
  Gene Name: aurora kinase B
  ENST ID: ENST00000581511
  CDS Start-End: 57-742
ggcagattcagttgtttgcgggcggccgggagagtagcagtgccttggaccccaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgag

SEQ ID NO: 110369 - DNA, 867 bp, Homo sapiens
  Payload ID: 1657
  Gene Symbol: AURKB
  Gene Name: aurora kinase B
  ENST ID: ENST00000577833
  CDS Start-End: 176-867
tgcgggcggccgggagagtagcagtgccttggaccccagcacattccaccccggtcatcagacaaaggcaccctcagagctaccccctgctccttctcaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaaccaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaaccc

SEQ ID NO: 110370 - DNA, 1227 bp, Homo sapiens
  Payload ID: 1657
  Gene Symbol: AURKB
  Gene Name: aurora kinase B
  Uniprot ID: Q96GD4
  ENST ID: ENST00000585124
  CDS Start-End: 95-1129
ccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttccgtgcccatgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacct

SEQ ID NO: 110371 - DNA, 771 bp, Homo sapiens
  Payload ID: 1657
  Gene Symbol: AURKB
  Gene Name: aurora kinase B
  ENST ID: ENST00000582368
  CDS Start-End: 256-771
cccagctctcctccccctttctctctaaggatggcccagaaggagaactcctacccctggccctacggccgacagacgtacgggtcccaagtttgacgacagaacccgctctggtcatttgtagccacatcctgtcaggtgctgccaacgtgaatctgaccagccagtgactcccagctggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagag

SEQ ID NO: 110372 - DNA, 1247 bp, Homo sapiens
  Payload ID: 1658
  Gene Symbol: AURKC
  Gene Name: aurora kinase C
  Uniprot ID: Q9UQB9
  ENST ID: ENST00000302804
  CDS Start-End: 187-1116
cggctgctcacgacgccgcggatcccgaagcctgtgtagcagtgagacatcagtgaggctgcaggacgagcaggattggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagttggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacca

SEQ ID NO: 110373 - DNA, 1318 bp, Homo sapiens
  Payload ID: 1658
  Gene Symbol: AURKC
  Gene Name: aurora kinase C
  ENST ID: ENST00000448930
  CDS Start-End: 364-1188
cacaacggccatcaccacctctccgcaccctctgtctccttccttctcgggcctcacccctggccctcgctttcagtgcccagcccggaccgcagcactccagttccgccccaacccgggaaccctggactgaggctcccgtttctgtcctttctattgggcgcacttccgatggcgtcaggaatttcagccaataggagccagccaggaagtacctctctgagcggttggtgccgggtataaaagaaggccgcgcagccacggctgctcacgacgccgcggatcccgaagcctgtgtagcagtgagacatcagtgaggtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcaccccctccctgagaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacc

SEQ ID NO: 110374 - DNA, 978 bp, Homo sapiens
  Payload ID: 1658
  Gene Symbol: AURKC
  Gene Name: aurora kinase C
  Uniprot ID: Q9UQB9
  ENST ID: ENST00000415300
  CDS Start-End: 106-978
ggaagtacctctctgagcggttggtgccgggtataaaagaaggccgcgcagccacggctgctcacgacgccgcggatcccgaagcctgtgtagcagtgagacatcatggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctga

SEQ ID NO: 110375 - DNA, 1610 bp, Homo sapiens
  Payload ID: 1658
  Gene Symbol: AURKC
  Gene Name: aurora kinase C
  ENST ID: ENST00000601799
  CDS Start-End: 110-250
ggaagcgccccggccagaaagtgaccccccacccctttcaggaccctgtgaacgggaacagccatccagagggttcaggaaggcgtccgcgccctcacctcttctccccatgagctcccccagagctgtggtgcagctgggcaaagctcaacctgcaggcgaagagtgtgagagccagcgccagagaaaggacgcagggaaggctggggactgggccaggggtcgggtgcacagaagacacatgtgttgacatctcccctccctctcctcctccccaacgctcttcttttctccccactccctcccttccctccaattctttctttcacctctccctcccctactctctcctccccttcctttctctctgcctcttcttcacctcctcctcccctccctaccttaccttactctttcttcttccccttacctctccctccccctctccctgccttccccttccctctctttctctcctccccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgagataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacca

SEQ ID NO: 110376 - DNA, 545 bp, Homo sapiens
  Payload ID: 1658
  Gene Symbol: AURKC
  Gene Name: aurora kinase C
  ENST ID: ENST00000594599
  CDS Start-End: 1-414
aggggtgagctctacaaggagctgcagaaaagcgagaaattagatgaacagcgcacagccacggtgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacca

SEQ ID NO: 110377 - DNA, 921 bp, Homo sapiens
  Payload ID: 1658
  Gene Symbol: AURKC
  Gene Name: aurora kinase C
  ENST ID: ENST00000599062
  CDS Start-End: 1-921
atgagctcccccagagctgtggtgcagctgggcaaagctcaacctgcaggcgaagagtcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctga

SEQ ID NO: 110378 - DNA, 877 bp, Homo sapiens
  Payload ID: 1658
  Gene Symbol: AURKC
  Gene Name: aurora kinase C
  ENST ID: ENST00000596375
  CDS Start-End: 59-400
ctcctctctttcagtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacggtgagataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctc

SEQ ID NO: 110379 - DNA, 1125 bp, Homo sapiens
  Payload ID: 1658
  Gene Symbol: AURKC
  Gene Name: aurora kinase C
  Uniprot ID: Q9UQB9
  ENST ID: ENST00000598785
  CDS Start-End: 168-995
cccttcttcccctcacctctcgctccctattcccttctctactgttctcctctcctctctttctctccccttctccttccctcccctctcccttcctatctccctcctcctcctctctttcagtggctacagcaaaccaaacagcccagcagcccagcagcccagccatgcggcgcctcacagtcgatgactttgaaatcgggcgtcccctgggcaaggggaaatttgggaatgtgtacctggctcggctcaaggaaagccatttcattgtggccctgaaggttctcttcaagtcgcagatagagaaggaaggactggagcaccagctgcgccgggaaattgagatccaggctcatctacaacaccccaatatcctgcgcctgtataactatttccatgatgcacgccgggtgtacctgattctggaatatgctccaaggggtgagctctacaaggagctgcagaaaagcgagaaattagatgaacagcgcacagccacgataatagaggagttggcagatgccctgacctactgccatgacaagaaagtgattcacagagatattaagccagagaacctgctgctggggttcaggggtgaggtgaagattgcagattttggctggtctgtgcacaccccctccctgaggaggaagacaatgtgtgggacactggactacttgccgccagaaatgattgaggggagaacatatgatgaaaaggtggatttgtggtgcattggagtgctctgctatgagctgctggtgggatatccaccctttgagagcgcctcccacagtgagacttacagacgcatcctcaaggtagatgtgaggtttccactatcaatgcctctgggggcccgggacttgatttccaggcttctcagataccagcccttggagagactgcccctggcccagatcctgaagcacccctgggttcaggcccactcccgaagggtgctgcctccctgtgctcagatggcttcctgagccctgtctgcctctgttccctttgtgtgtgttcagggagctctcctggctctgccacctcatttgtctttatttttttctcttttaagatgtaagatgctaattaataaaagctgaatcatttcatacc

SEQ ID NO: 110380 - DNA, 6173 bp, Homo sapiens
  Payload ID: 1659
  Gene Symbol: AUTS2
  Gene Name: autism susceptibility candidate 2
  Uniprot ID: Q8WXX7
  ENST ID: ENST00000342771
  CDS Start-End: 322-4101
ctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcacccca

SEQ ID NO: 110381 - DNA, 5950 bp, Homo sapiens
  Payload ID: 1659
  Gene Symbol: AUTS2
  Gene Name: autism susceptibility candidate 2
  Uniprot ID: Q8WXX7
  ENST ID: ENST00000406775
  CDS Start-End: 736-4443
cgctcgcagtttcgccctctcttccgctaatgattgcattattatgctcccctctctggggggtctcgcccctcttgggtcgctccggagccccggcctcccctggctgcatttcttaaaaatttgggagcctgggagtgagttttctccgaggcgtgtgtgagaggcggcgggggtgttttcctgcgcgaggggcgggtgaagttcattgcccccacttttcccgcgacctttttcggacccgattttggatcgagttgaggggggcgcgggcgttttcggggggcggggggcgcggcggagaatggccgcggggagggctccccggagcctcccagtctcttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttctgtgacagtgacagtgaccaggaagagaaggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaa

SEQ ID NO: 110382 - DNA, 957 bp, Homo sapiens
  Payload ID: 1659
  Gene Symbol: AUTS2
  Gene Name: autism susceptibility candidate 2
  Uniprot ID: Q8WXX7
  ENST ID: ENST00000403018
  CDS Start-End: 44-844
agcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttcagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttca

SEQ ID NO: 110383 - DNA, 550 bp, Homo sapiens
  Payload ID: 1659
  Gene Symbol: AUTS2
  Gene Name: autism susceptibility candidate 2
  ENST ID: ENST00000418686
  CDS Start-End: 1-550
acgttatggagaggagttattctacatctcactgccccgataaatgagtctcttcctaataaagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacc

SEQ ID NO: 110384 - DNA, 542 bp, Homo sapiens
  Payload ID: 1659
  Gene Symbol: AUTS2
  Gene Name: autism susceptibility candidate 2
  ENST ID: ENST00000443672
  CDS Start-End: 1-542
tgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgtt

SEQ ID NO: 110385 - DNA, 595 bp, Homo sapiens
  Payload ID: 1659
  Gene Symbol: AUTS2
  Gene Name: autism susceptibility candidate 2
  ENST ID: ENST00000416482
  CDS Start-End: 1-595
ctctttttctcctggtgctttccagagcctttggagacctgtgccgggggtggggcttggagctcccgtgccgatggttaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagaagcagcactccagcgaagactcagcccgcccca

SEQ ID NO: 110386 - DNA, 565 bp, Homo sapiens
  Payload ID: 1659
  Gene Symbol: AUTS2
  Gene Name: autism susceptibility candidate 2
  ENST ID: ENST00000449547
  CDS Start-End: 1-302
tggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttactcccaataatatgtattcattttaactctgaatgctgttaaaagttttttgggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacgg

SEQ ID NO: 110387 - DNA, 449 bp, Homo sapiens
  Payload ID: 1659
  Gene Symbol: AUTS2
  Gene Name: autism susceptibility candidate 2
  ENST ID: ENST00000439256
  CDS Start-End: 1-188
ttgacagatcctttcagacctatgttaaggaaaccagggaagtggtgtgctatgcatgttcacatcgcctggcagatttaccaccaccaacagaaagtcaaggtcagtccgaccttcgtggtgtagggaagaatgggatgcacataaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgtta

SEQ ID NO: 110388 - DNA, 4583 bp, Homo sapiens
  Payload ID: 1659
  Gene Symbol: AUTS2
  Gene Name: autism susceptibility candidate 2
  ENST ID: ENST00000611706
  CDS Start-End: 57-3092
aggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagacatccaaccctatcgatgtcgctgctcggcctgggacagtcccacacactttactccaaaaggacccgaggttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgc

SEQ ID NO: 110389 - DNA, 4511 bp, Homo sapiens
  Payload ID: 1659
  Gene Symbol: AUTS2
  Gene Name: autism susceptibility candidate 2
  ENST ID: ENST00000615871
  CDS Start-End: 57-3020
aggcatcagatgccagctctgaaaaactcttcaacactgttattgtaaacaaagatccggagttaggtgttggcacgctaccagaacatgacagccaggatgcagggccgattgtccccaagatatcgggtctagagagaagccaggagaagagccaggactgttgcaaagagccaatctttgagcctgtggtgcttaaagacccctgccctcaggtcgcacagccaataccccagccgcagacggagccccaactccgagctccttctccggaccctgacttggtgcagcgcacagaggccccacctcaacccccacctctgagtacacagccaccacagggccctcctgaggcccagctccagcctgccccgcagcctcaggtgcagaggccacccaggccacagtcccccacccagctgctccatcagaacctcccacctgtgcaggcccacccctctgctcagagcctctcccagccattgtcagcctacaacagcagtagcttaagcctcaacagtttaagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatgtttgacaaataccctacaaaagttgacccattctaccggcacagtctcttccattcctatcctcctgcagtgtcgggcatcccccctatgatcccacccactggcccttttggttcactacaaggagcatttcagccgaagttgacagatcctttcagacctatgttaaggaaaccagggaagtggtgtgctatgcatgttcacatcgcctggcagatttaccaccaccaacagaaagtcaagaaacagatgcagtcagacccacataagctggactttggactgaaacctgagttcctgagccgccctccaggccccagtctttttggagccatccaccacccccatgacctggcacggccttcaactttgttctctgccgctggtgctgcacacccaactgggaccccttttgggccacctcctcatcacagcaacttcctcaaccctgctgcccacctagagccttttaatcggccgtctacattcacaggcctagcagcagttggtggcaatgccttcgggggacttggaaatccttccgttacacccaactcaatgttcggccacaaggatggccccagtgtgcagaactttagcaaccctcacgaaccctggaaccggctgcaccgaacgcctccgtcgttcccgacccctccgccctggctgaagccaggggagctggagcgcagcgcgtccgctgcagctcatgacagagatagagatgtagataaacgagactcatctgttagtaaagatgacaaagaaagggaaagcgtcgagaagagacactccagccacccttcaccagcacctgtcctcccggtgaatgccctgggacatacccgcagctccactgaacagatccgggctcatctgaacactgaggctcgggagaaggacaaacccaaagagagggagagagaccactcggaatcccgcaaggacctggccgccgacgagcacaaggcgaaagagggccacctgcccgagaaggacgggcacggccacgaggggcgcgccgcgggcgaagaggccaagcagctggcccgggtgccgtctccctacgtgcggaccccggtggtggagagtgccaggcccaacagcacctcgagccgggaggccgagccgcgcaagggtgagccggcctacgagaaccccaagaagagctccgaggtcaaggtgaaggaggagcggaaggaagaccatgacctgcctccagaggccccgcagacccaccgggcctcggagccgccgcctcccaactcctcgtccagcgtgcacccggggcccctggcctcgatgcccatgacggtgggggtgacgggcattcaccccatgaacagcatcagcagcctggacaggactcgcatgatgacccccttcatgggcatcagccccctcccgggcggagagcgcttcccgtacccttctttccactgggaccccatccgggaccccttgagggatccttaccgagaacttgacattcaccggagagacccgctgggcagggacttcctgctaaggaacgacccgctccaccggctctcgactccccggctgtacgaagccgaccgctccttcagggaccgggagcctcacgactacagccaccaccaccaccaccaccaccacccgctgtctgtggaccctcggcgggagcacgagcggggaggccacctggacgagcgggagcgcttgcacatgctcagagaagactacgagcacacgcggctccactccgtgcaccccgcctccctcgacggacacctcccccaccccagcctcatcaccccgggactccccagcatgcactatccccgcatcagccccaccgcgggcaaccagaacggactcctcaacaagacccctccgacagcagcgctgagcgcacctcccccgctcatctccacgctggggggccgcccggtctctcccagaaggacgactcctctgtccgcagagataagggagaggcccccttcccacacgctgaaggatatcgaggcccgataagccgagaacaggagcaagaacgaggaagaagaaaccctaggcagacaccaggccaggcttgagagacagaactcctgcatggctcacacagactgggggggaaagccccaccccttccccttgtaaaaaatgtatagactcagtgcacattttgaaatgttttgtatattatatgttgagatttttcagatcttttagcccagtcatatgttctcacgtctcctactttttgtttctcgtataaaactttttgatttgaaccaaaacagtgaagatgacaacacacaccaattggatgataattgtagcgggggcggtgggggggagaagtccacgccatccatcatgcaaaattctttcagatgaggtgggaaggccgtgtacatagttatgtaaaaagagattgcttcatgagctaatggttcatatatgcaaaagggtaagatgaaagctttactttgtacaaatgtaaatagataaagtaacataatacattaatacttcttaaaatgtgctatttgcaaacttacttaatatcagtgaacacagtcggctaaagctgtgttcccatatattgttatagacagctaaacccttcaactatgcaatgaatgttcgggcttttcacaaaagcccgcctaactcaaaggagccttttcaaatccatttacagcatacttaaggtcatattttccctgaacaagcgcttacgtgatatgactctgttttccttgcttgttttttttcaaacggagaaacatcctgttttgcaaattggaccccaggctggaacttagcatctgaagttgccgcttgtgggctctgggggaaagtgtagccccggagaggtaactgaggacatgagcaaccagtgccagggagggtgggatttgccagatgccaaaatcaggggacgggtggtggtgtctgtcagacacacacaggtcgccagtgacttcacacacacctcatgtgagaaccatgccttttttagtgtgtcctatttcatacctgtacacacttcctcgttttgtaatgagatttacttacacccaaacagatcctgaaagaaagcttcaagttttctcagatgatggatatgttttcactgtattcaataactgacggatgtaaggtgcacgtttcctgatgtgacgcactgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgc

SEQ ID NO: 110390 - DNA, 3600 bp, Homo sapiens
  Payload ID: 1660
  Gene Symbol: AMFR
  Gene Name: autocrine motility factor receptor, E3 ubiquitin protein ligase
  Uniprot ID: Q9UKV5
  ENST ID: ENST00000290649
  CDS Start-End: 212-2143
ctcttccgcgccggcaggggcagcagcgggagcagcgcggggcggagcggcgccagcagccaggagcggcccggcccggcccggcgcggcggcggcggcggcagcggcagcggcagcgacgccagagcccgtgggcgccgttcgcgaggccgccgcagaggcccggccgcagcgcagggaagcctgggggccagaggtcgccgctgccgccatgccgctgctcttcctcgagcgcttcccctggcccagcctccgcacctacacgggcctcagcggcctggccctgctgggcaccatcatcagcgcctaccgcgcgctcagccagcccgaggccggccccggcgagccggaccagctaacggcctcgctgcagcctgagccgccggcgcccgcccggccgagcgccgggggaccccgggcccgcgatgtggcccagtacctgctctcagacagcctcttcgtgtgggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatgggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaactcta

SEQ ID NO: 110391 - DNA, 567 bp, Homo sapiens
  Payload ID: 1660
  Gene Symbol: AMFR
  Gene Name: autocrine motility factor receptor, E3 ubiquitin protein ligase
  ENST ID: ENST00000563664
  CDS Start-End: 72-567
aacatcgcgtggggttgcgaggaggaggccccgaggggcaggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacag

SEQ ID NO: 110392 - DNA, 866 bp, Homo sapiens
  Payload ID: 1660
  Gene Symbol: AMFR
  Gene Name: autocrine motility factor receptor, E3 ubiquitin protein ligase
  ENST ID: ENST00000567738
  CDS Start-End: 1-866
tggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaactcctgtcttcgttcctggctagaacaagacacctcctgtccaacatgcagaatgtctcttaatattgccgacaataatcgtgtcagggaagaacatcaaggagagaacttggatgagaatttggttcctgtagcagcagccgaagggagacctcgcttaaaccaacacaatcacttcttccatttcgatggagatgacagctccatgcgtgttactgcccctgaagacgttccagtgggacaggaggtggaggtggtcgacagtgatactgatgctcctgacctgtggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcag

SEQ ID NO: 110393 - DNA, 803 bp, Homo sapiens
  Payload ID: 1660
  Gene Symbol: AMFR
  Gene Name: autocrine motility factor receptor, E3 ubiquitin protein ligase
  ENST ID: ENST00000565445
  CDS Start-End: 116-803
ctaggggcccctccgccagggacccccgagggcgagcgcctggggggcgcggccttgctcgcgggagcgctgctgagggagagtggttctagtaaataccgcttgctgtgttttgatgttggtggctaagctcatccagtgtattgtgtttggccctcttcgagtgagtgagagacagcatctcaaagacaaattttggaattttattttctacaagttcattttcatctttggtgtgctgaatgtccagacagtggaagaggtggtcatgtggtgcctctggtttgccggacttgtctttctgcacctgatggttcagctctgcaaggatcgatttgaatatctttccttctcgcccaccacgccgatgagcagccacggtcgagtcctgtccctgttggttgccatgctgctttcctgctgtggactggcggccgtctgctccatcaccggctacacccacggaatgcacaccttggctttcatggctgcagagtctcttcttgtgacagtgaggactgctcatgtgattttacgatacgtaattcacctctgggacctcaaccacgaagggacgtgggaaggaaaggggacgtatgtctattacacagactttgtcatggagctcactctcctgtccctggacctcatgcaccatattcacatgttgttatttggcaacatctggttatccatggccagcctggtcatctttatgcagctgcgttacctgtttcatgaggtgcaacgtcgaattcgtcggcacaagaactatctacgtgtggttggaaacatggaggcca

SEQ ID NO: 110394 - DNA, 2249 bp, Homo sapiens
  Payload ID: 1660
  Gene Symbol: AMFR
  Gene Name: autocrine motility factor receptor, E3 ubiquitin protein ligase
  ENST ID: ENST00000492830
  CDS Start-End: 1-900
tatttggcaacatctggttatccatggccagcctggtcatctttatgcagctgcgttacctgtttcatgaggtgcaacgtcgaattcgtcggcacaagaactatctacgtgtggttggaaacatggaggccaggtttgcagttgcaactccagaggagctggctgtcaacaatgacgactgtgccatctgttgggactccatgcaggctgcgcggaaactgccctgtggacatcttttccacaaggtctcggattgcgagctggctgccgagtttttcggttgaagtgatgcacaccaccaacattcttggcattacgcaggccagcaactcccagctcaatgcaatggctcatcagattcaagagatgtttccccaggttccataccatctggtactgcaggacctccagctgacacgctcagttgaaataacaacagacaatattttagaaggacggattcaagtaccttttcctacacagcggtcagatagcatcagacctgcattgaacagtcctgtggaaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgccgcggaacggaggcttcagaagcagcagacctcctagcgctcccttgccttcctcagctgcctcctgcgccctgtgcccgactgactggaggaggcctgtcccaattctgcccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagcagtcgcctgcctgcagcaggcagcttctactcctgcctcatgcgtacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttg

SEQ ID NO: 110395 - DNA, 2257 bp, Homo sapiens
  Payload ID: 1661
  Gene Symbol: AIRE
  Gene Name: autoimmune regulator
  Uniprot ID: O43918
  ENST ID: ENST00000291582
  CDS Start-End: 128-1765
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 110396 - DNA, 3033 bp, Homo sapiens
  Payload ID: 1662
  Gene Symbol: ATG10
  Gene Name: autophagy related 10
  Uniprot ID: Q9H0Y0
  ENST ID: ENST00000282185
  CDS Start-End: 295-957
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtcccttaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactggtgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcggggaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaactggtgttataaacatgacctatcttaagtgattttcccacaatcaaactcaggaacaatagattatttctgttttactccaaaagagagagagagagtgagtgtgagtgtgtgtgtgtgtgtgtgtgtatgtgtgggtgtttgtgtagatagttgtaaaacaaagaaaaaacacaatattttactgtgagataatatgttttaccagcaaagtgtggcatagtaattagaagttttctaaaaagctataggagatatttaaacattaaaatttctttttgacctatagtaataaaacaatggtcattttacccctctgcttctcaaccccacagctgctctgctgtactctttgagggctcttgagcgagtcttcatgtccctgagacttattttcctcatctttaatttgaaactaacaagctacctcatagggttgctgtgagaaccacatgagatcattaatgcatgataagatattgtaaagtattatacgaatattcattaaatgctcacctttcttgtatataattggtattcactaaggctgtaaataagtttcatagccagttaagtattaagataaacctaacctggaacaattttttttttggttgcttgttttgttttttgctttcatttgctaggagctgaaacgaagattaaaatgtcattggctttttagagagtctagattagtgtgtctttgaatgagggatatacttaaaatcacctgaggatcgtttacagctacagatgctggggccacctgacacagtctctctgggggtgattctgctctggagaacctctggtctggatatacctttattgtgacattgatttgtattgttttgctctactgacaggccttttccaatccatacaagctgaacttgcttcctaatgtttgtctaggccttacatggatagtaaggaagcttaggagacatgtacacaaggcagcccacttgtaggaaactgcttcaggtgaggacatcattcaccagtggatcaccgagcaccgtgacagcaccctcagtccacgtctgcagattaagagctgaactctcacagagaaagtggaagtagagaaagggttaattcaaactgctagaaaagctaaaagtaaattttaaaatgctgagctgcccatattcatgctaggatgagagccggcttaaatgcttgctgggcattttggtatttaccacttagcatgttttcaacttctgtgagggattttccccccaatctccctaatgtaaacacagatttctcagcaagtcatttctcaagccatgtcatttctagtgtaaaataaattataataatgtgtcatctgaa

SEQ ID NO: 110397 - DNA, 1438 bp, Homo sapiens
  Payload ID: 1662
  Gene Symbol: ATG10
  Gene Name: autophagy related 10
  Uniprot ID: Q9H0Y0
  ENST ID: ENST00000355178
  CDS Start-End: 295-672
agtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggtgaagtcttgctctgtcacccaggctggagtgcagttgcgtgatctcagctcactgcaacctccgccttctgggttcaagcagttctcctgcctcagccttccgagtaactgggactacaggggttcaccactacacctggctaattttttgtatttttagtagagataaggtttcaccatgttggtcaggctggtcttgaactcctgacatcaagtaatccatccgcctcagcctcccaaagtgctgagattacaggcatgagccactgtgcctggccctgagcttaaaataaaagttaaattaaaaaaaaaataatgttgatgttttcatttttgcaatcaatagcttagttagactcaaattgcaaactgtcattgcctgtagtaggcagtggcatagaactcaattcagctcttttaacctgagttttaagctgctttcagattgccccacacatacatggttcaggagtcagccagagacttgggctgagtttaaacatagaatctggggttgtcctcttctggctgtcttctttcttgggcatctgcatcattctctagcacctatggtttttccaggctctttcccccagtttcctccagtcagaaagatggcaagagtttttgctgcctgccctcccccagtccttgtgccaacaccaccaccattgcagctgcctccagggaaaaactgcaaaaaccaaatcacttgctccaggtgttgactcctcttcaaaatctatttttgttaaatctccaaagcctcaaataggttttcttcctagaatttatatctgttatttgtagcaggattggtctgtaaggcactcagtcttctacatcatgggtcagcagattacagcccttgggttaaatccagccacctgcttgttttattaataaagttttgttggaactaaacc

SEQ ID NO: 110398 - DNA, 1795 bp, Homo sapiens
  Payload ID: 1662
  Gene Symbol: ATG10
  Gene Name: autophagy related 10
  Uniprot ID: Q9H0Y0
  ENST ID: ENST00000458350
  CDS Start-End: 404-1066
gcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggtagagacggggtttcaccgtgttagccaagatggtctcgatctcctgacctcgtgatccgcccgcctcggcctcccaaagtgctgggattacaggcgtgagccactgcgcccggcctgttgtacagttattaaagttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtcccttaacaagattcttctattgagtttaggaattgcggcacgaagaatgccaagagtttacctggccagccctggctttaataggactgataccatggaatatttcatctcaccaagatgtgacatggattatttttcccttggacacaaatgtctacagcaactggtgtttgataggctgaatgtttagaagaaacacttcaaagggatacatcatggccaggcatggtggctcacacctgtaatccaagcactttgggaggccaaggtgggagcatcacttgatcctgggagttcgagaccagcctgggcaacatggtgaaaccctgtcggtacaaaaaaatacaaaaatttgcctgtttatggtggtgtgttcctgtagtcccagctccccaggaggctgaggtgggaggttggctttaacccaggaggcagaggttgcagtgagctgagactgtgccactgcagtccagcctgggtgacagagccagacactgtctcggggaaaaaaaaaaaaaaaaaaagacacatcactataaatagcaaaaaaacaaatctaacttattaatactaggaataccaacattattagggcacttgcaggttattcttttctaggccaagtacttcacttccatttgtctgacatggagattgagggagaaatgtatttgtgtgttcattttaatgtaagatatataaaaattaaattactggatttacctgtccctgaaa

SEQ ID NO: 110399 - DNA, 549 bp, Homo sapiens
  Payload ID: 1662
  Gene Symbol: ATG10
  Gene Name: autophagy related 10
  ENST ID: ENST00000510085
  CDS Start-End: 441-549
gtgcgcacgctccgactcggccgtggcggacctgactgaaggaggccgcggacctgactgaaggaggccacggccacttctggttggcctcggggcgcgctggctcggctcttcctccgccctcgaggcccccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagagggagtcttgctctgtcgcccaggctggagtgcagtggcacgatctcggctcactgcaacctctgcctctcgggttaaagcaattctcctgcctcagcctcccgagttgctgggactacaggtgcccgccaccacgctcagctaatttttttatcatttaacatggaagaagatgagttcattggagaaaaaacattccaacgttattgtgcagaattcattaaacattcacaacagataggtgatagttgggaatggagaccatcaaagg

SEQ ID NO: 110400 - DNA, 813 bp, Homo sapiens
  Payload ID: 1662
  Gene Symbol: ATG10
  Gene Name: autophagy related 10
  ENST ID: ENST00000504770
  CDS Start-End: 59-574
gccctcgccgggctgggctgcggggtcaggggccgagcggagagggttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacagatcttcaccaagaggtgttcagaaggacatatttcagtgacaaagaatattatcccagaatgaatgctgacacatagggaaaaatggaacatccaatacttgggcaacccttttttgtacttcatccctgcaagacgaatgaattcatgactcctgtattaaagaattctcagaaaatcaataagaatgtcaactatatcacatcatggctgagcattgtagggccagttgttgggctgaatctacctctgagttatgccaaagcaacgtctcaggatgaacgaaatgtcccttaacaaggt

SEQ ID NO: 110401 - DNA, 978 bp, Homo sapiens
  Payload ID: 1662
  Gene Symbol: ATG10
  Gene Name: autophagy related 10
  Uniprot ID: Q9H0Y0
  ENST ID: ENST00000513443
  CDS Start-End: 448-825
ccgcagtcccatcattcagttccgtagggtcaccggcgcggcagtggcctcgcagggcgctgggtccctctccccagctctcctccccctggccccgtcgccccgccctcgccgggctgggctgcggggtcaggggccgagcggagaggggtgagtattccccacagcccttgccggttgtctcctcccggctctgcttcccacacggtccttgccccactcctaggacagggaggaagggcacgcgcgggtaggcgggaaacagcccagtcctgaacaaaaggccggggaagcgggtccccgccggtaactgcaggcctgtgctggccgccgcgagcggggaagggcgaggacactccctcctcggggacccggtccccgtcgcgcacacggtgtcaccagcacacctggcccagtacccaaagcaccctcgaattatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggtgaagtcttgctctgtcacccaggctggagtgcagttgcgtgatctcagctcactgcaacctccgccttctgggttcaagcagttctcctgcctcagccttccgagtaactgggactacaggggttcaccactacacctggctaattttttgtatttttagtagagataaggtttcaccatgttggtcaggctggtcttgaactcctgacatcaagtaatccatccgcctcagcctcccaaagtgctgagattacaggcatgagccactgtgcctggccctgagcttaaaataaaagttaaattaaaaaaaaaa

SEQ ID NO: 110402 - DNA, 618 bp, Homo sapiens
  Payload ID: 1662
  Gene Symbol: ATG10
  Gene Name: autophagy related 10
  ENST ID: ENST00000513634
  CDS Start-End: 14-568
gttatcatttaacatggaagaagatgagttcattggagaaaaaacattccaacgttattgtgcagaattcattaaacattcacaacagataggtgatagttgggaatggagaccatcaaaggactgttctgatggctacatgtgcaaaatacactttcaaattaagaatgggtctgtgatgtcacatctaggagcatctacccatggacagacatgtcttcccatggaggaggctttcgagctacccttggatgattgtgaagtgattgaaactgcagcagcgtccgaagtgattaaatatgagtatcatgtcttatattcctgtagctaccaagtgcctgtactttactttagggcaagctttttagatgggagacctttaactctgaaggacatatgggaaggagttcatgagtgctataagatgcgactgctacagggaccatgggacactattacgcaacaggaacatccaatacttgggcaacccttttttgtacttcatccctgcaagacgaatgaattcatgactcctgtattaaagaattctcagaaaatcaataagtaagaaacaccatcaagatacattggcttctactctgattttaaaagtgtaaa

SEQ ID NO: 110403 - DNA, 1439 bp, Homo sapiens
  Payload ID: 1663
  Gene Symbol: ATG101
  Gene Name: autophagy related 101
  Uniprot ID: Q9BSB4
  ENST ID: ENST00000336854
  CDS Start-End: 479-1135
gcggcttccggtcccggctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtacaagatctccttccagatcactgatgccctgggcacctcagtcaccaccaccatgcgcaggctcatcaaagacacccttgccctctgagcgtcgctggatctctgggagctccttgatggctcccagaccttggcttttgggaattgcacttttgggcctttgggctctggaacctgctctgggtcattggtgagacttggaaggggcagcccccgctggcttcttggttttgtggttgccagcctcaggtcatccttttaatctttgctgacggttcagtcctgcctctactgtctctccatagccctggtggggtcccccttctttctccactgtacagaagagccaccactgggatggggaataaagttgagaacatgagtttgggctg

SEQ ID NO: 110404 - DNA, 658 bp, Homo sapiens
  Payload ID: 1663
  Gene Symbol: ATG101
  Gene Name: autophagy related 101
  ENST ID: ENST00000548915
  CDS Start-End: 236-658
ccgggagagtggtggcatctgagaggctgctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgg

SEQ ID NO: 110405 - DNA, 846 bp, Homo sapiens
  Payload ID: 1663
  Gene Symbol: ATG101
  Gene Name: autophagy related 101
  ENST ID: ENST00000553049
  CDS Start-End: 276-846
aggtggtctggagcctgccgggagagtggtggcatctgagaggctggtcgtggactgtggttgggggagctggtctcttgtggctcagcgccgtgcggaggttgaagcgtacctgcggaggtcgcaccagggcgtgaggaggaggaggaagggcatgagccgagcttgaggaatccgtgctccaaactctacactcaagggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaaggatgcactgcgcaactctggtggcgatgggctggggcagatgtccttggagttctaccagaagaagaagtctcgctggccattctcagacgagtgcatcccatgggaagtgtggacggtcaaggtgcatgtggtagccctggccacggagcaggagcggcagatctgccgggagaaggtgggtgagaaactctgcgagaagatcatcaacatcgtggaggtgatgaatcggcatgagtacttgcccaagatgcccacacagtcggaggtggataacgtgtttgacacaggcttgcgggacgtgcagccctacctgtaca

SEQ ID NO: 110406 - DNA, 671 bp, Homo sapiens
  Payload ID: 1663
  Gene Symbol: ATG101
  Gene Name: autophagy related 101
  ENST ID: ENST00000550604
  CDS Start-End: 419-671
gctcagcctccgacccaggtggtctggagcctgccgggagagtggtggcatctgagaggctggtcgtggactgtggttgggggaggtgggagctgttttaaccgtgtgccccctctcctgtgccggcgtgggcatcccccggggcagtggaacgcgggcgctcctccagcttccgagtccagccagcctgggcgcggggcgccgcccccgagacacccgaggagtccgttcctccctggttacgtggactgtggaggttcgcgcgtagtggcggcgggggatacgggacccgggcgggaattccttcctgcgtccgtcccgagtctcttgatatggagccaaggtggcccttgggtagggtgaagatcccctgtctttatcctagttccacaccttggtgtgggttactgggtgcaggatgaactgtcgctcggaggtgctggaggtgtcggtggaggggcggcaggtggaggaggccatgctggctgtgctgcacacggtgcttctgcaccgcagcacaggcaagttccactacaagaaggagggcacctactccattggcaccgtgggcacccaggatgttgactgtgacttcatcgacttcacttatgtgcgtgtctcttctgaggaactggatcgtgccctgcgcaaggttgttggggagttcaagg

SEQ ID NO: 110407 - DNA, 1082 bp, Homo sapiens
  Payload ID: 1664
  Gene Symbol: ATG12
  Gene Name: autophagy related 12
  ENST ID: ENST00000379594
  CDS Start-End: 286-513
gtccgagccagcggcctaactggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaaatgacagtggtctctggccgggcgcggtggctcactcctgtaatcccagcactttggtaggctgaggcgggtggatcacctgaggtcaagagttcgagaccagcctggccaacatgttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgc

SEQ ID NO: 110408 - DNA, 1558 bp, Homo sapiens
  Payload ID: 1664
  Gene Symbol: ATG12
  Gene Name: autophagy related 12
  ENST ID: ENST00000513322
  CDS Start-End: 272-442
cctaactggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaagtaactgaatttatttccgggcagagaggcgggaggttcagattgcatccgagtaggggtggcggccagtaaagaagcaaaatttagaggagcgcctgtcctagacctgcattttgaccagtcatcagaagaaaagaagtgtactttttgatttttaaggcctttaagttgagtgttaaaataccatctctgtctatcggtgtagggcctgatacttggctgccacacttatttttatactgtatttttttgagttggccagactgcgagctctttgaaggagggagggagctgagtggggcggggggaggggggtctcggtaattccaggtacttaacacaggagctaattatttgagtaatgttttatggtggtaggggtggtcattggcaaagcctggattagaattcatgccttccaacttaactcgcttttgcttttttccccctcccagttggttgtgaattcactccttaaaccaaaaaccaaattcttatgcagaatgaagactgctaagggaaagctaaaggcatagatgttacctttttaagaaacacattttggaacctttttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaaga

SEQ ID NO: 110409 - DNA, 4333 bp, Homo sapiens
  Payload ID: 1664
  Gene Symbol: ATG12
  Gene Name: autophagy related 12
  Uniprot ID: O94817
  ENST ID: ENST00000509910
  CDS Start-End: 307-729
ggaaagcggaaacatttctaggtccgagccagcggcctaactggagtgtgcgcattcgaccgagcacagacacgttgcccaccgctcctctcccgaggtctgtagtcgcggagaaacacatgttgcgttactaacgttcagaggtctgcgacagcttcgatttgaatgactagccgggaacaccaagtttcactgtgtaattgcgtccccctactccggcgcctcctttgcgacgctccctggagaaaagcacgcccactgcacgcgctcagtcgctacttccgctctcgagtgtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaattattaggctgcagaggcaagaggatcccctgagcccagaagttcaagggtatagtgagtcgtgattgtaccactgcattcctgctgagcaacagagtgagaccccatctcaaaaaagaaaaaaaaaggcattctagtaaatcgaatgtaatgtgaatggaatttcaaaacaggatctaagatggtatgtagtagaattcaaagtaatatcattttaaagttaaatgagtatggaaaaggtctgttctctagttttgtccagttcagtttactgaaggaatatatttaattatattcatatatttaacaaataaaaatatgttgaattttcgtattgtttgccactgagggttcagatgatagacctcaaaaaatcgaaaatactggttgaaatttgtagcatccatttagttattctttttgacctaaataacttaatagtttattaaatctaaggttagctaaatatgtagctaaccttatttgttttctttcctaacaactctgaagaatacataggactttgcactttttttttttttttttttttttaaagagacagcgtttcggtcttgttgcccaggctggactgtaatggcacaatcttggctcattgcaacctctacctcccgggttcaagtgattctcctgcctcagcctcctgagtagctgggattacaggcacctgccaccacacccgcctaattttttgttatttttagtggagacagggttttaccattttggccaggctggtctcaaactcctgactgacctcaggtgatccacccgccttggcctcccaaagtgctgggattataggtgtgagccaccgtgccgggcctggactttgtactttttcaaatcatatttaattatttcttgatctttactcaaagaattattctgcgctaaatttgcaacattaaacaataattaagcctggatccgataagttattgggtgactagaacctacaacacaatttatttttaatttaaactctcaagtctgattaaacttgggggaaaaactgaacattcaggtgatattttaaattttctttgtgactaaatagatgtcattaatatcatgcttcatcttactgtgcatagatgacccatggcacacaaagtatatgtataatattgcaatattgtacttccatctttaaaagtatgccaaagacttcataatgaattcaccatatttaaggaataaggcaaattaatgtttatccgaaatcaaaatgagattggataattcctggaatctgatttctgtaagtttcagtcctaaagggaccttaaatatctactagaacgaagtacagtgtatttctcagattacatgacattagtcaaccaatttagttgtaacacaaagtgagaaagccttaggtgttgaaggagtgtgaaaataaaaatctcttttcatgcagtttctgcttcattttccaaggattataatatgctgagtaaacttttggcactaaggaagccagctacaggccacgtaatgaaaactattcagaaaacagttcagcaaatactactatttgaatacagttcaaatcgtatttatataaatactctgcctacattatttaacccaaactggattattcaccattctttgaagatgccttgtgttttctgttatctacttctgctcgtgcagtttacttacaccttcaccctttcaaatcctaactcttcttcaaggcctgattcagattttaactttttaaaggctatctgaatcattcaaggagaagataccctttctctcataaaaacacttagagcaaactaccactattaaatcacttattgcatactgcctcagagccatgtgtccagttattctggtttttatctggtacccacacacacataatacttagtacatttccttatatgtaaataattagtaatgtaacacatcgagtgaatgaaattgtgattagcaaagtatgacagctaaaaacaaaggaaattttgtatagtttaagtttttgtacagcagaaggtaatggaaaatatttgcaacatatgacagtgtttttaatgtcttaagtatatgaagaatttgtttcaattggtaagaaaagaccaactgaaaaataggcaaaacataccaaatttcgattcacaaaaagatacaaatggccaacaaaacatgaaacaccttgaaccccattggttacaaaaaatacaaataaaaacaatgctgactgacaataaaaataatgtacatcttgctattagcagagttgtggggaaatcctgtcatattttggtgaatagaatatgagttggtatatcacttttagggggccatttggcaatatcaaaaaccttgaaacgtaagtataaacttcagtttgttcgtataacctgtcattcacatattgagtgcctactatgtcctaaatattggaataacactaataaagctcataagagactaa

SEQ ID NO: 110410 - DNA, 1430 bp, Homo sapiens
  Payload ID: 1664
  Gene Symbol: ATG12
  Gene Name: autophagy related 12
  Uniprot ID: O94817
  ENST ID: ENST00000500945
  CDS Start-End: 14-238
gtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaatttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgatagtacacccattgctcctacttgttactattattgctgcagatctgcctccaaggttgaaaaggagactaagactgtataaacatcttcattgtcagttctcaaaatgactgaaattgttttcatggtaaaagttaatatactaaagggttcctttttttttaatgtttacatttatctctatgtttacctttttagtcacattgacctgctggctgaatacctcaaatagtccagtagagggcagtccaccaggcagaaaaggttaggcgttttggtttcacatctttgctggggaataataggggaaatggctgtttttgctaatttttagctaatatctagccaggagagcaagcacataggacagactgaaagactgtaattttacacaatacacatggcttaattattttattgggatacagaaaaatataaattctggacaaataagtcatatacctgttttcagtcctaacatttaaggattcttgagtcccaatcacataactgtggtgttactctgtcatttatatggtgtcaaaagcacttgatgagtaaacccagtagcatctttttgagtgtttcataatgcattttccaacttgaaaacaataattgaaaaatagccttattgtatattttatgccatgactaaaagtgccatttttactgatgctattagactgataatttcttgaagtgaaatttaacctttttttctctttagtattatgtttataatgccatatttttagaaagcattccagatcaggcatggtggcttacacctgtaatcccagcactttggaaggctgaggtgtggggattgcgtgaagccacaagtttgagaccagcctggttagcaaggcaagatccccaactctacaaaaaaataaaaattaaaaaaaaa

SEQ ID NO: 110411 - DNA, 732 bp, Homo sapiens
  Payload ID: 1664
  Gene Symbol: ATG12
  Gene Name: autophagy related 12
  ENST ID: ENST00000513167
  CDS Start-End: 1-178
ggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattggttgtgaattcactccttaaaccaaaaaccaaattcttatgcagaatgaagactgctaagggaaagctaaaggcatagatgttacctttttaagaaacacattttggaacctttatgacagtggtctctggccgggcgcggtggctcactcctgtaatcccagcactttggtaggctgaggcgggtggatcacctgaggtcaagagttcgagaccagcctggccaacatgttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaa

SEQ ID NO: 110412 - DNA, 773 bp, Homo sapiens
  Payload ID: 1664
  Gene Symbol: ATG12
  Gene Name: autophagy related 12
  ENST ID: ENST00000505993
  CDS Start-End: 1-199
gtctccaagcaagatggcggaggagccgcagtctgtgttgcagcttcctacttcaattgctgctggaggggaaggacttacggatgtctccccagaaacaaccaccccggagcccccgtcttccgctgcagtttccccgggaacagaggaacctgctggcgacaccaagaaaaaaattggttgtgaattcactccttaaaccaaaaaccaaattcttatgcagaatgaagactgctaagggaaagctaaaggcatagatgttacctttttaagaaacacattttggaacctttttgacattttgctaaaggctgtgggagacactcctattatgaaaacaaagaagtgggcagtagagcgaacacgaaccatccaaggactcattgacttcatcaaaaagtttcttaaacttgtggcctcagaacagttgtttatttatgtgaatcagtcctttgctccttccccagaccaagaagttggaactctctatgagtgttttggcagtgatggtaaactggttttacattactgcaagtctcaggcgtggggatgaaccacaaagaaaatcaacttgctactacatgaaatggattttcacggaagagacagctctgaaaagttttgatgcttgtggcaagagacttaacagatgtgatctatttagtatgtgtctactctatgtttatgcataagaaaacatccatagcatgaatggactcagaaaaatgtgatttgtattaatgcaccagtcatcataaaagatggtcatgata

SEQ ID NO: 110413 - DNA, 4348 bp, Homo sapiens
  Payload ID: 1665
  Gene Symbol: ATG13
  Gene Name: autophagy related 13
  Uniprot ID: O75143
  ENST ID: ENST00000359513
  CDS Start-End: 309-1862
cgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttacagcctcctgtcctgtaggttgtctgaagacctcgtaaccccttccccacccctgccccagtgcaggtctgggaaaggggagagtggtgcgttgtgaagcgcagaaagacctcaagtgtctgggcaagcctgttttgagtcgggtgtggcctcttaggggctgtataccctggggtttcctgggtcaggaaacttcttagtatttctctttccctggtcccctatcaggggcttgaatttgaatattcagttggagaatgcatttaaaatacacccatagtaaaatctccataaaatgca

SEQ ID NO: 110414 - DNA, 937 bp, Homo sapiens
  Payload ID: 1665
  Gene Symbol: ATG13
  Gene Name: autophagy related 13
  ENST ID: ENST00000395549
  CDS Start-End: 342-937
ggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggtcattctgctatgatatagaacactggaacttattcctcctatctaactgtggccttgtacctgctgaccaatttctcaccatcaacctacaccctacttccccatcctctgattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccag

SEQ ID NO: 110415 - DNA, 667 bp, Homo sapiens
  Payload ID: 1665
  Gene Symbol: ATG13
  Gene Name: autophagy related 13
  ENST ID: ENST00000529395
  CDS Start-End: 1-237
ccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgagcccaccgttgactacgagttcccagtagatggtgcgctagtcattgttcttcctgagccagagtcactaatcccccacagactataaaccatggcccctcggcttacgggtttgtagccagcattaagttcttcccagaattttcagattgtttacagtaacttgaatctgggtcacagcatcagccctaatcctgccttgctatgaaacaggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttg

SEQ ID NO: 110416 - DNA, 4199 bp, Homo sapiens
  Payload ID: 1665
  Gene Symbol: ATG13
  Gene Name: autophagy related 13
  Uniprot ID: O75143
  ENST ID: ENST00000526508
  CDS Start-End: 458-2011
gaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttaca

SEQ ID NO: 110417 - DNA, 2351 bp, Homo sapiens
  Payload ID: 1665
  Gene Symbol: ATG13
  Gene Name: autophagy related 13
  Uniprot ID: O75143
  ENST ID: ENST00000528494
  CDS Start-End: 305-1957
gggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagtgtgtgtttactgtcacaaaggcacattttcagacccctactcctgtggtgacggacaccctgagggtccccatggcaggactggccttttcccatcaactctcaagctctcgcctttcctatcagcctgctgccctgggcgttggatcagctgacctggcttatccagtagtgtttgctgctggcttaaatgctacacaccctcaccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtt

SEQ ID NO: 110418 - DNA, 4014 bp, Homo sapiens
  Payload ID: 1665
  Gene Symbol: ATG13
  Gene Name: autophagy related 13
  Uniprot ID: O75143
  ENST ID: ENST00000524625
  CDS Start-End: 384-1826
caaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctctaggattttgtcacttggagtcacagcaaagttctcttcctcttgtccccccgttgctgctccttggttatagaacatggtaaatatttattactttcagagaaaccagatattttatagaggaaatatgtttgaggtgagttgtttttcacttggagaaggcggagggctcttcctgggacggagacctcctcctccggaggttattgagaatccgggctgctgctttgaggatcttcccaccatacagacagcgagatccaagaagagggctggccgggggcaaagtcacctcccagtgtggctgcactggaactgactaaaggctttaccttggatagttgcgtattcctggtgagagccttacatctcccacagtttctgcagagtgactgactccattctggcagcccaggaagtcctgggtgctaaatgtgatggccacatgtagtggttaggggatgttgtgtgtgtcccccaactgcctgggtacttgttcctgatccctggggctgtcctgtggagcttttcctcctgcttgggcctagctaccatctccctctaatcccaggttctctacactgccctggggtttaccagctggattggcttctggttgagaaatcaaagctgggcgtatgattgacttaacccttcaggtattgttacttgaataagtcaagtgcctagcctcacccacctatgatctgtcctttcccagcctcgctggtagtcctggtcaaggagatctaggtctactccattcctcctggcccacctggggcattcactggcagcagctgtgcttcagtggagcaggtggttctcagctgcttgttagtatactgcatgtgacactgttcccacatacaaggctgacttctgaggattggagcaggctctggcggggaccagagctctgcgtgctgctgctgccaccaagaagtgttagcagaagcagtagcagccaactggccctcctgactttggcccagagcacatgcgtggcttgctgaacccaggctcaggtttatccccaaggccccagctttgagaagggggaaggcccctggtaagttattgatgcccccatatttcagctactgctctctttccaaggccttgcatggaaaggcctagccattgtctgaggcagcaatctttggcatctacaggtggcagcagcctttcaccagggctccatctgtgaagagtctcagccatgactttgagctgagcttgggagaagtaaagcaactgttaaggccagcccttgcccctcagacctgccatgaaaggaatgagccctagactgactcctgcagcacccccgggacaggctgggaccagctgtttgtctccaggtgtcagagtccctcctcctcctccaacctctccaacctactttgtttggaaataccgagctacacttcaaaatgtattcaagggatttccaataaatttttttctgtactttaca

SEQ ID NO: 110419 - DNA, 2566 bp, Homo sapiens
  Payload ID: 1665
  Gene Symbol: ATG13
  Gene Name: autophagy related 13
  Uniprot ID: O75143
  ENST ID: ENST00000529655
  CDS Start-End: 415-1857
ccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctggattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaagaggaaggagacagtgccaggaggaagaaggaaggagtcccttagctctcttcattgtcccctttacttcctgctatcttcttctcctcttcttctctctcttgcctctatgcctgtatttctggcaatatgacaggcctgcctacccaagatcagaactccaaaaccactcccacccctgaaggtcgggagggtctgagcagccctggtggctgcctgtgctcaggtcctcagctccatgggaaataaaaatggcaccctgaatctct

SEQ ID NO: 110420 - DNA, 583 bp, Homo sapiens
  Payload ID: 1665
  Gene Symbol: ATG13
  Gene Name: autophagy related 13
  ENST ID: ENST00000531933
  CDS Start-End: 1-142
cccgtctgtagaagactctcaagaagtgtgtaccacctctttttccacctccccaccatcccaggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctgccggcctcctgcctgggcctgccttgcagctggccccttccctgcctgctgtcaccatccactgtttgacattccagctggtggccaagagattggtgtggagtcgcagaaag

SEQ ID NO: 110421 - DNA, 2030 bp, Homo sapiens
  Payload ID: 1665
  Gene Symbol: ATG13
  Gene Name: autophagy related 13
  Uniprot ID: O75143
  ENST ID: ENST00000530500
  CDS Start-End: 497-1702
gaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaacagactgtcattgctgctgaagtcccttcttgctataactagggtgacaccagcctataggctctccaggaaacaagggcatgaatatgtcatattatacaggatatattttggagaagttcagctgagtggcttaggagaaggcttccagacagttcgtgttgggacagtgggcacccctgtgggcaccatcactctttcttgtgcttacagaattaacttggcattcatgtctaccaggcaatttgagaggaccccacctatcatggggattattattgatcactttgtggaccgtccctatcccagctcctctcccatgcacccctgcaattacagaactgctggtgaggacactggagtaatatacccgtctgtagaagactctcaagaagtgtgtaccacctctttttccacctccccaccatcccagctgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatggacctggggaccttctatcgggagtttcagaacccacctcagctgagcagcctctccatagatattggagcacagtccatggctgaagacttggactcattaccagagaagctggctgtgcatgagaagaatgtccgcgagtttgatgcctttgtggaaaccctgcagtaaaagtatccttgagtcccagcagcaccccctttttgtggccccagggcataagcagcctcccatgcatcagctgctcccacccctcatcctgctctgagccaggtggaagggaggctggcttctcccatggggacccagaagtccctactcttggacctcctggagactccgtggcggcagtcaagcccagtgcccagttggagaagactcacgtgctggccttggagatgggaagaaccttcgtacgaaaaagccctcagcagggccatctgtgtgccctgcccatcaccaactgcttcccaagggtgtcatcctgttcctcctgctg

SEQ ID NO: 110422 - DNA, 581 bp, Homo sapiens
  Payload ID: 1665
  Gene Symbol: ATG13
  Gene Name: autophagy related 13
  ENST ID: ENST00000525009
  CDS Start-End: 1-581
gtgtttactgtcacaaaggcacattttcagacccctactcctgtggtgacggacaccctgagggtccccatggcaggactggccttttcccatcaactgatggttcctgggaaggaaggtggggtaccccttgctcccaaccagcctgtccatggtacccaggctgaccaggagagactggcaacctgcaccccttctgacagaacccactgtgctgccacaccctccagtagtgaggatactgaaaccgtatcaaacagcagtgagggacgggcctcccctcacgatgtcttggagaccatctttgtccgaaaagtgggggcttttgtcaacaaacccattaaccaggtgaccctgacgagtttggatataccctttgccatgtttgctcccaagaatttggagctggaggataccgatccaatggtgaatcctccagattccccagagactgaatctcctctccagggcagcctgcactcagatggctccagcgggggcagcagtggcaatacccatgatgactttgttatgatagactttaaaccagctttttctaaagatgacattcttccgatgga

SEQ ID NO: 110423 - DNA, 1021 bp, Homo sapiens
  Payload ID: 1665
  Gene Symbol: ATG13
  Gene Name: autophagy related 13
  ENST ID: ENST00000533325
  CDS Start-End: 665-1021
ccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggcatcttggactcaagtgattctcctgcctcagcctcctgagtagctgggactacaggacagaaaattttaataacaagatagtaagcagctcacatgaacttacatattcagcatattagcaggaaagaggcaagacatttgaagaacttgcagaaaagttgcaaagtaaatgagagactagaatgctcaaagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaagacatcccagaggttacacatgaagcaaagaaggcactggcaggacagctgcctgcagtcgggaggtccatgtgtgtggagatttcacttaagacttctgagggagattccatggagctggaaatatggtgtcttgaaatgaatgaaaagtgtgataaagaaatcaaagtttcctacacggtgtacaac

SEQ ID NO: 110424 - DNA, 297 bp, Homo sapiens
  Payload ID: 1665
  Gene Symbol: ATG13
  Gene Name: autophagy related 13
  ENST ID: ENST00000532067
  CDS Start-End: 1-127
caaacccattaaccaggtgaccctgacgagtttggatataccctttgccatgtttgctcccaagaatttggagctggaggataccgatccaatggtgagcccaccgttgactacgagttcccagtagatggtgcgctagtcattgttcttcctgagccagagtcactaatcccccacagactataaaccatggcccctcggcttacgggtgaatcctccagattccccagagactgaatctcctctccagggcagcctgcactcagatggctccagcgggggcagcagtggcaatac

SEQ ID NO: 110425 - DNA, 613 bp, Homo sapiens
  Payload ID: 1665
  Gene Symbol: ATG13
  Gene Name: autophagy related 13
  ENST ID: ENST00000577256
  CDS Start-End: 444-613
ggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctggcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattggttcaacttagcaatcaaaga

SEQ ID NO: 110426 - DNA, 587 bp, Homo sapiens
  Payload ID: 1665
  Gene Symbol: ATG13
  Gene Name: autophagy related 13
  ENST ID: ENST00000578626
  CDS Start-End: 488-587
ggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagcatcttggactcaagtgattctcctgcctcagcctcctgagtagctgggactacagagacagaatctctccatgttgtccaggctggtctcaaactcctgggctcaagagatcatcccaccttggccttccaaagtgttgggattacctatattcctataggcaatggaaactgatctcaattcccaggacagaaaggacctggacaagtttattaaattttttgccctcaagactgtccaagtgattgtccaggctcggcttg

SEQ ID NO: 110427 - DNA, 619 bp, Homo sapiens
  Payload ID: 1665
  Gene Symbol: ATG13
  Gene Name: autophagy related 13
  ENST ID: ENST00000581438
  CDS Start-End: 580-619
attaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcaggtgagggtgactgttgactagtgaaaaaagggacccatggttcacgactgtcttcttactggcagtggaacgacctgtggaaacctgtgatccattctcattaaataaatctctggtcttgctctgttgcccaggctggagtgtagtggtgtgatcttggctcgctgcaacctctgcctcccaggttcaagcgattctcctgcctcagcctcctgagtaactgggattacagattcctataggcaatggaaactgatctcaattcccaggacagaaaggacctgg

SEQ ID NO: 110428 - DNA, 624 bp, Homo sapiens
  Payload ID: 1665
  Gene Symbol: ATG13
  Gene Name: autophagy related 13
  ENST ID: ENST00000580238
  CDS Start-End: 527-624
gtagccctctttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctgggctggagtgtagtggtgtgatcttggctcgctgcaacctctgcctcccaggttcaagcgattctcctgcctcagcctcctgagtaactgggattacagattcctataggcaatggaaactgatctcaattcccaggacagaaaggacctggacaagtttattaaattttttgccctcaagactgtccaagtgattgtccaggctcggct

SEQ ID NO: 110429 - DNA, 544 bp, Homo sapiens
  Payload ID: 1665
  Gene Symbol: ATG13
  Gene Name: autophagy related 13
  ENST ID: ENST00000583249
  CDS Start-End: 464-544
attaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtcttgctctgttgcccaggctggagtgtagtggtgtgatcttggctcgctgcaacctctgcctcccaggttcaagcgattctcctgcctcagcctcctgagtaactgggattacagattcctataggcaatggaaactgatctcaattcccaggacagaaaggacctggacaagtttattaaattttttgccctcaagactgtccaagtg

SEQ ID NO: 110430 - DNA, 600 bp, Homo sapiens
  Payload ID: 1665
  Gene Symbol: ATG13
  Gene Name: autophagy related 13
  ENST ID: ENST00000582547
  CDS Start-End: 487-600
aacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctggtcttgctctgttgcccaggctggagtgtagtggtgtgatcttggctcgctgcaacctctgcctcccaggttcaagcgattctcctgcctcagcctcctgagtaactgggattacagattcctataggcaatggaaactgatctcaattcccaggacagaaaggacctggacaagtttattaaattttttgccctcaagactgtccaagtgattgtccaggctcggcttggtgaaaagatttgc

SEQ ID NO: 110431 - DNA, 741 bp, Homo sapiens
  Payload ID: 1665
  Gene Symbol: ATG13
  Gene Name: autophagy related 13
  ENST ID: ENST00000581416
  CDS Start-End: 592-741
tttcaccccccccccccggccattaccgaagcggatgaaaacaaacactaacgatggcggcgccgggaagcgaccggctgctgggcttaaggcgggagtgaccgcttaaccagtgagggaagcactgaagagcgccagtcgacgtgggtgcgacaactcgcggagtcttaggagcaaaacgtctggggcctgcgagccaggacccttctgaagccttaggtgtctatcggcgacgtgtacggtcactgcagctccggagcgcggaaccctcagccaggaggcgcggctggtcggtcccaggtcccggcctccgtaatgagagcccggaaccactctttgtgccgcagcttcgcagtggaacgacctgtggaaacctgtgatccattctcattaaataaatctctggtcttgctctgttgcccaggctggagtgtagtggtgtgatcttggctcgctgcaacctctgcctcccaggttcaagcgattctcctgcctcagcctcctgagtaactgggattacagcatcttggactcaagtgattctcctgcctcagcctcctgagtagctgggactacagattcctataggcaatggaaactgatctcaattcccaggacagaaaggacctggacaagtttattaaattttttgccctcaagactgtccaagtgattgtccaggctcggcttggtgaaaagatttgcactcgttcatcatcttctccaacgggttcagattgg

SEQ ID NO: 110432 - DNA, 4742 bp, Homo sapiens
  Payload ID: 1666
  Gene Symbol: ATG14
  Gene Name: autophagy related 14
  Uniprot ID: Q6ZNE5
  ENST ID: ENST00000247178
  CDS Start-End: 37-1515
aaaatcccacgtgactggctctcctctcaggccatcatggcgtctcccagtgggaagggagcccgggcgctggaggctcctggctgcgggccccggccgctcgcccgggacctggtggactccgtggacgatgcggaggggctgtacgtggctgtggagcgctgcccgctgtgcaacactacccgccggcggctgacctgcgccaaatgcgttcagagcggcgatttcgtctacttcgacggccgcgaccgggagaggtttatcgacaagaaggaaaggttaagccgacttaagagcaagcaagaagaatttcagaaagaagtgttaaaagctatggaaggaaaatggataacagatcagttgagatggaaaataatgtcctgcaagatgaggattgaacagttaaaacaaacaatatgtaaaggaaatgaagaaatggagaaaaattctgaaggccttctcaaaaccaaggaaaagaatcagaagctttacagtcgagcacaacggcaccaagagaaaaaggagaagattcagaggcataatcgcaaacttggtgacctggtagaaaaaaagaccattgacttaagaagtcattatgagcgtctggcaaatcttcgacgatcccatatattagagctcacctctgtcatttttccaatcgaggaagtaaagacgggtgtgagagaccccgcagatgtgtcttcagagagtgacagtgccatgacctccagcactgtgagcaagcttgctgaagcccggaggacaacttacctctcaggacgatgggtctgtgacgatcacaacggagacaccagcattagcattacagggccttggattagcctccctaacaatggggactactctgcctactacagctgggtggaggagaagaaaacaacccaggggcctgacatggagcagagtaaccctgcctacaccatcagtgctgcgctgtgctatgcaactcagctggtcaacattctgtctcatatacttgatgtaaatcttcccaaaaagctctgcaacagtgaattttgtggcgaaaatctaagcaagcagaaatttactcgagcagtgaagaaactgaatgcaaatattctttacctttgtttttctcagcatgtaaatttagatcaattacaaccactgcataccctcaggaatctaatgtacctggtcagtccaagctctgaacacctaggcaggtcagggccctttgaagtacgagcagaccttgaggagtccatggaatttgtggatcccggagttgctggagaatcagatgagagcggagatgagcgcgtcagcgatgaagaaaccgacctgggcacagactgggagaacttgcctagtccccggttttgtgatatcccttcccagtctgtggaagtctcccagagtcagagcacccaggcgtccccacccatcgcgagcagcagtgcaggtgggatgatctcctctgcagcagcctcggtgacctcctggtttaaagcttacactggacaccgttaacgagcatggaccaaaacataccaaatctgcatcaagaaagttcttctcccactacactctagtaaacattttctgtttaagttaagatagtgtctggaacaaagaggttaaagtgttgttttgttttgtctttttaagcagggagacaaacatttctatttgccaagtggcctgtgatggtgaccaacatgcttatgataattaagagaacaggggtcgaaggtctttctacccagaccagtgctggtggaaggaggacctgtgcgtgtggccagttctgccaaggaagcagttgatttgggttccctctgggcccgggccaccgggcccacagatatgggtcagtgtgctggtccttgcggtgctgagactgttcctgacactttaagttttagaggttggttgaatcacaagaggtgattcttgattattaggacatgaaagataaaagctctttaataagagtttttctgccattgttttttgtatgagaaccagcaggcaatttaaaatttctaatttggtcctttgattttgtttgggaggggtgagttacacgtattttattcatgctgctctgtcgtagtttgtcagacattcctgtttttctttcccccacacaccaaagaaaatgaaagtctttttctttaggacccacatccataaatggaagaaatcctggctgcaataatgtctagagagtttttaactattttcttgtattctgaggggaattaagcttattcttacctagttgaattcctgccatccacactatgagcattttgaaattgaacttatattttctgggtgaaaataagtcatgaaggtcattcccttatgtaagctcaatgcctgcctgggcacaggggaaaagccacttagttaagtggcctctggtcattcttgtggtgtccactttctttctatgggattgagtaggtggcaggtgttttcaggggaaaccatcctacttgtttccccgaactctttgttgctctgaggacacagctttgctcagaaatgcagcgcagatccttacggctgatgctactctgctctgttctggggaaagcacaatataaagaaagaatttcccagccaggcgcagtggctcacgcctgtaatcccagcactttaggaggccgaggcaggcggatcacttgaggtcaggagtttgagagcagcctggctaacatggtgaaaccctgtttctactaaaaatacaaaaaattaccgggtgtggtggcgcacgcctgtaatcccagctactcgggaggctgcggcaggagaatcgcttgaaccgggaggcagaggttgcagtgagccgagattgtgccattgcactccagcctgggcaacaagagcgaaactccgtctcaaaaaaaaaaagaatttccctcagcaggagatcattttcagctcacgtgtcttgtcattcttttagtgacaatcttacaagaaaactataatgagagaggcattatgtacaaatatgtaagtagtttatttttaataactgcaaaaaaatcctatgtaacaactaccaaaagaaatcctatgaaagagtcctaacaggcattattaccatatcttatgtgattggcatgatagcacctctgataaatcattcagaggtttgccatgccccagcttcttttctcatcataataattgtagttgatactttgcctccaagtccgaggtgctatatagcttttgctaatggtatatttggtgttttgtatagttttgggtagagttgcagaacggagtttatttctatccggtagtcacaaattccttggctctatgaattttccatgaaaggaggaagtaggcttttctcgttgtgggtggtcttttttttttttggagacggagtctcactcagctgcccaggctggagtgtagtggcaccatctccgctcactgcaaccaccatctcctgggttcaagcaattcttccatctcaacctcccgagtagctgggattataggcacctgccatcatgcccagctaatttttgtattttagtaaagacgggggttttcaccatgttggccaggctggtcttgaactcctgacttcaggtgatccgcttgccttggcctcctaaagtgctaggattacaggcctgagccaccgcgcccggccccttatgggttcttctacactgctgggatctctgttttaagtgctcagcttcatgattgattgctgggcttccattttcccatccagttctggagttcgtagagagtgaagatggtagacttgaacagataaataaacttaacgatcttgtaagagttgtctagctacttaaaaccctcagaagtaagagcttagtctcacgagttgtaagagtgggatttggagcttggtggtggagactgacttcagctgagagatgcacaacagtcatggttttcttaagcctcttatgaaaccatgaatgagagatgaagctaaagaatagaatccagagatcacaaactcatctagagtacttccacaaaatttacaaagatgtgggaactttatggataggatatattttgtttgttgttgttaatatcaactagaggcactttacatagggttaagtgatcgaacccttttgtggttttgaacaccaacatactggcttacactgctgaaatattttgggtttcattattttgcactggatccaccctgtaaatactcttaagtatacatttcaaccactgttttttctactctttttgctgctcattaaaatctttcatgtaggtgccagaaccatatgtaaacagctttttaaaaaattgaagctggtattttgtttaaacaaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggaaaaacagtatatcaccattgggtagagtggacgggactcatgtaaggactcaatttggggaagagcattcagtggcatgctgttagaggactagtgtccgagaatctcctcacagtatcatgttgcaggaattccccattgctctgcaacttccaaaccagtttgagtcatacaaatgttttctaaacttttattgtattactgcaataaatcttttaacagt

SEQ ID NO: 110433 - DNA, 2915 bp, Homo sapiens
  Payload ID: 1667
  Gene Symbol: ATG16L1
  Gene Name: autophagy related 16-like 1
  Uniprot ID: Q676U5
  ENST ID: ENST00000347464
  CDS Start-End: 258-1592
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcc

SEQ ID NO: 110434 - DNA, 2767 bp, Homo sapiens
  Payload ID: 1667
  Gene Symbol: ATG16L1
  Gene Name: autophagy related 16-like 1
  Uniprot ID: Q676U5
  ENST ID: ENST00000373525
  CDS Start-End: 157-1443
aagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 110435 - DNA, 3405 bp, Homo sapiens
  Payload ID: 1667
  Gene Symbol: ATG16L1
  Gene Name: autophagy related 16-like 1
  Uniprot ID: Q676U5
  ENST ID: ENST00000392017
  CDS Start-End: 258-2081
actagcgagcgccctgcgtaggcaccggctcctgagcccgtgcttcgggtgagggggcgggtcttccggccctctcgaaaatcatttccggcatgagccggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 110436 - DNA, 3313 bp, Homo sapiens
  Payload ID: 1667
  Gene Symbol: ATG16L1
  Gene Name: autophagy related 16-like 1
  ENST ID: ENST00000392018
  CDS Start-End: 115-1989
gtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 110437 - DNA, 3213 bp, Homo sapiens
  Payload ID: 1667
  Gene Symbol: ATG16L1
  Gene Name: autophagy related 16-like 1
  Uniprot ID: Q676U5
  ENST ID: ENST00000392020
  CDS Start-End: 123-1889
gtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 110438 - DNA, 3301 bp, Homo sapiens
  Payload ID: 1667
  Gene Symbol: ATG16L1
  Gene Name: autophagy related 16-like 1
  ENST ID: ENST00000392021
  CDS Start-End: 156-272
agaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcaataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctgacctggagacggagtgcctagacctgcgcactaagctttgtgaccttgaaagagccaaccagaccctgaaggatgaatatgatgccctgcagatcacttttactgccttggagggaaaactgaggaaaactacggaagagaaccaggagctggtcaccagatggatggctgagaaagcccaggaagccaatcggcttaatgcagagaatgaaaaagactccaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttgggagacgctctgtctcttccttcccagtcccccaggacaatgtggatactcatcctggttctggtaaagaagtgagggtaccagctactgccttgtgtgtcttcgatgcacatgatggggaagtcaacgctgtgcagttcagtccaggttcccggttactggccactggaggcatggaccgcagggttaagctttgggaagtatttggagaaaaatgtgagttcaagggttccctatctggcagtaatgcaggaattacaagcattgaatttgatagtgctggatcttacctcttagcagcttcaaatgattttgcaagccgaatctggactgtggatgattatcgattacggcacacactcacgggacacagtgggaaagtgctgtctgctaagttcctgctggacaatgcgcggattgtctcaggaagtcacgaccggactctcaaactctgggatctacgcagcaaagtctgcataaagacagtgtttgcaggatccagttgcaatgatattgtctgcacagagcaatgtgtaatgagtggacattttgacaagaaaattcgtttctgggacattcgatcagagagcatagttcgagagatggagctgttgggaaagattactgccctggacttaaacccagaaaggactgagctcctgagctgctcccgtgatgacttgctaaaagttattgatctccgaacaaatgctatcaagcagacattcagtgcacctgggttcaagtgcggctctgactggaccagagttgtcttcagccctgatggcagttacgtggcggcaggctctgctgagggctctctgtatatctggagtgtgctcacagggaaagtggaaaaggttctttcaaagcagcacagctcatccatcaatgcggtggcgtggtcgccctctggctcgcacgttgtcagtgtggacaaaggatgcaaagctgtgctgtgggcacagtactgacggggctctcagggctgggaggaccccagtgccctcctcagaagaagcacatgggctcctgcagccctgtcctggcaggtgatgtgctgggtatagcatggacctcccagagaagctcaagctatgtggcactgtagctttgccgtgaatgggatttctgaagatttgactgaggtctctcttggcctggaagaataacactgaaaaaacctgacgctgcggtcacttagcagaggctcaggttcttgccttgggaaacactactagctctgaccttccatacctcacttgggggagcacagggccccgctgggcctcctcaccaacggcagtgccaaaatcagcccccacatcaaggtggtgttctctgtgctttctctcgtccttccaaagtcggttctggcctaacgcatgtcccaacaccttgggttcatttgcccggtgaactcactttaagcattggattaacggaaactcccgaactacagacccctccctggtgggttgcatgaatgtgtctcattactgctgaaatgtcctcacatctctttcactgttcttcagagctttctggctctctttcccccacaaaattcgacatatttaaaaatctccgtgtggctttaaaaaatggttttttgtttttttgtttttttgaggtgggagaggatgtgtgaaaatcttttccagggaaatgggttcgctgcagaggtaaggatgtgttcctgtatcgatctgcagacacccagaaggtgggtgcacactgcatgcttgggggtgccaagggattcgagacctccaacatacttgtctgaaggtggtgattctggccatggcccctctgccaagcctgtgtgcgatgcccttggtgctttagtgcaagaagcctaggctcagaagcacagcagcgccatctttccgtttcaggggttgtgatgaaggccaaggaaaaacatttatctttactattttacctacgtataaagttttagttcattgggtgtgcgaaacaccctttttatcacttttaaatttgcactttattttttttcttccatgcttgttctctggacatttggggatgtgagtgttagagctggtgagagaggagtcaggtggccttcccaccgatggtcctggcctccacctgccctctcttccctgcctgatcaccgctttccaatttgcccttcagagaacttaagtcaaggagagttgaaattcacaggccagggcacatcttttatttatttcattatgttggccaacagaacttgattgtaaataataataaagaaatctgttatatacttttcaaactcca

SEQ ID NO: 110439 - DNA, 589 bp, Homo sapiens
  Payload ID: 1667
  Gene Symbol: ATG16L1
  Gene Name: autophagy related 16-like 1
  ENST ID: ENST00000431917
  CDS Start-End: 424-589
ttttctgacgggctggctggcctgcactggtttcttagcttttctgagcctcaatctcctcatctgtacaatggaaagaaggctacctggtgtggttgtcgaagattcactgagctcatctctgcaaagcccctggctcggcgcctggccctgctgtaggggttcagtgagtgttatcccgttccctcatccttcgagacaaggcagtgagggagggcaccgtgcacagcatcggaaaagaagcaaatagaagagctttggggatgcaggaacgtccaaagcagagataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaaaattgcagaatgtttgcagactatctctg

SEQ ID NO: 110440 - DNA, 644 bp, Homo sapiens
  Payload ID: 1667
  Gene Symbol: ATG16L1
  Gene Name: autophagy related 16-like 1
  ENST ID: ENST00000419681
  CDS Start-End: 153-644
ccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccacgagacgctctgtctcttccttcccagtcccccaggacaatgtggatactcatcctggttctggtaaagaagtgagggtaccagctactgccttgtgtgtcttcgatgcacatgatggggaagtcaacgct

SEQ ID NO: 110441 - DNA, 691 bp, Homo sapiens
  Payload ID: 1667
  Gene Symbol: ATG16L1
  Gene Name: autophagy related 16-like 1
  ENST ID: ENST00000444735
  CDS Start-End: 159-691
ggaagaccgtcccggatggcctcggggactgccagtgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataaggaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcctgctggaggccttctggattctatcactaatatctttggtctgtccgagtctccccttttgggacatcattcttcttctgatgctgccaggagacgctctgtctcttccttcccagtcccccaggacaatgtggatactcatcctggttctgg

SEQ ID NO: 110442 - DNA, 684 bp, Homo sapiens
  Payload ID: 1667
  Gene Symbol: ATG16L1
  Gene Name: autophagy related 16-like 1
  ENST ID: ENST00000417017
  CDS Start-End: 124-684
tgtgtggaggtgagctccgggattgccggcattcccgcttctgctggttgcttcatgctgcaggctgcggccgtcagccctcgctcgcattggtggcgctgaggtgccggggcagcaagtgacatgtcgtcgggcctccgcgccgctgacttcccccgctggaagcgccacatctcggagcaactgaggcgccgggaccggctgcagagacaggcgttcgaggagatcatcctgcagtataacaaattgctggaaaagtcagatcttcattcagtgttggcccagaaactacaggctgaaaagcatgacgtaccaaacaggcacgagataagtcccggacatgatggcacatggaatgacaatcagctacaagaaatggcccaactgaggattaagcaccaagaggaactgactgaattacacaagaaacgtggggagttagctcaactggtgattgacctgaataaccaaatgcagcggaaggacagggagatgcagatgaatgaagcaaagaggcggcaagcccggctgcagaaagagcttgcagaagcagcaaaggaacctctaccagtcgaacaggatgatgacattgaggtcattgtggatgaaacttctgatcacacagaagagacctctcctgtgcgagccatcagcagagcagccactaagcgactctcgcagcct

SEQ ID NO: 110443 - DNA, 3301 bp, Homo sapiens; identical to SEQ ID NO: 110438
  Payload ID: 1667
  Gene Symbol: ATG16L1
  Gene Name: autophagy related 16-like 1
  ENST ID: ENST00000631068
  CDS Start-End: 156-272

SEQ ID NO: 110444 - DNA, 684 bp, Homo sapiens; identical to SEQ ID NO: 110442
  Payload ID: 1667
  Gene Symbol: ATG16L1
  Gene Name: autophagy related 16-like 1
  ENST ID: ENST00000630596
  CDS Start-End: 124-684

SEQ ID NO: 110445 - DNA, 3313 bp, Homo sapiens; identical to SEQ ID NO: 110436
  Payload ID: 1667
  Gene Symbol: ATG16L1
  Gene Name: autophagy related 16-like 1
  ENST ID: ENST00000626639
  CDS Start-End: 115-1989

SEQ ID NO: 110446 - DNA, 691 bp, Homo sapiens; identical to SEQ ID NO: 110441
  Payload ID: 1667
  Gene Symbol: ATG16L1
  Gene Name: autophagy related 16-like 1
  ENST ID: ENST00000627513
  CDS Start-End: 159-691

SEQ ID NO: 110447 - DNA, 589 bp, Homo sapiens; identical to SEQ ID NO: 110439
  Payload ID: 1667
  Gene Symbol: ATG16L1
  Gene Name: autophagy related 16-like 1
  ENST ID: ENST00000629246
  CDS Start-End: 424-589

SEQ ID NO: 110448 - DNA, 2915 bp, Homo sapiens; identical to SEQ ID NO: 110433
  Payload ID: 1667
  Gene Symbol: ATG16L1
  Gene Name: autophagy related 16-like 1
  Uniprot ID: Q676U5
  ENST ID: ENST00000626623
  CDS Start-End: 258-1592

SEQ ID NO: 110449 - DNA, 644 bp, Homo sapiens; identical to SEQ ID NO: 110440
  Payload ID: 1667
  Gene Symbol: ATG16L1
  Gene Name: autophagy related 16-like 1
  ENST ID: ENST00000629673
  CDS Start-End: 153-644

SEQ ID NO: 110450 - DNA, 3213 bp, Homo sapiens; identical to SEQ ID NO: 110437
  Payload ID: 1667
  Gene Symbol: ATG16L1
  Gene Name: autophagy related 16-like 1
  Uniprot ID: Q676U5
  ENST ID: ENST00000630066
  CDS Start-End: 123-1889

SEQ ID NO: 110451 - DNA, 2767 bp, Homo sapiens; identical to SEQ ID NO: 110434
  Payload ID: 1667
  Gene Symbol: ATG16L1
  Gene Name: autophagy related 16-like 1
  Uniprot ID: Q676U5
  ENST ID: ENST00000630204
  CDS Start-End: 157-1443

SEQ ID NO: 110452 - DNA, 3405 bp, Homo sapiens; identical to SEQ ID NO: 110435
  Payload ID: 1667
  Gene Symbol: ATG16L1
  Gene Name: autophagy related 16-like 1
  Uniprot ID: Q676U5
  ENST ID: ENST00000625501
  CDS Start-End: 258-2081

SEQ ID NO: 110453 - DNA, 2243 bp, Homo sapiens
  Payload ID: 1668
  Gene Symbol: ATG16L2
  Gene Name: autophagy related 16-like 2
  Uniprot ID: Q8NAA4
  ENST ID: ENST00000321297
  CDS Start-End: 139-1998
ccaaagccctcttgggacaagccggggattccccgccgccgcccgccccctggcgtcacggagtccccgcgaggccccgccccggcctggcgccgtcctgggcgggaggaacgcgccgctaggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctgaa

SEQ ID NO: 110454 - DNA, 2254 bp, Homo sapiens
  Payload ID: 1668
  Gene Symbol: ATG16L2
  Gene Name: autophagy related 16-like 2
  ENST ID: ENST00000435507
  CDS Start-End: 32-397
ggaacgcgccgctaggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagcttgcttttcaggaagggggcgggcaggtgagcagccgactcccttagcgccttcggccccggagggactggaggcctggaggggcctcagcgccgccgtgcccacctgtccgcccccagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctg

SEQ ID NO: 110455 - DNA, 1575 bp, Homo sapiens
  Payload ID: 1668
  Gene Symbol: ATG16L2
  Gene Name: autophagy related 16-like 2
  ENST ID: ENST00000541367
  CDS Start-End: 1-1353
gcagggaggagtcgggcctcgccggtgtctggaagggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaa

SEQ ID NO: 110456 - DNA, 784 bp, Homo sapiens
  Payload ID: 1668
  Gene Symbol: ATG16L2
  Gene Name: autophagy related 16-like 2
  ENST ID: ENST00000537837
  CDS Start-End: 1-224
gggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcg

SEQ ID NO: 110457 - DNA, 963 bp, Homo sapiens
  Payload ID: 1668
  Gene Symbol: ATG16L2
  Gene Name: autophagy related 16-like 2
  ENST ID: ENST00000535830
  CDS Start-End: 1-963
gaggaaaggccccgcccctgcagggaggagtcgggcctcgccggtgtctggaagggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaa

SEQ ID NO: 110458 - DNA, 295 bp, Homo sapiens
  Payload ID: 1668
  Gene Symbol: ATG16L2
  Gene Name: autophagy related 16-like 2
  ENST ID: ENST00000541554
  CDS Start-End: 1-295
agcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagggggccccactgcacccaggtcatccctgtgcagggccgggtcacctccctgagcctcagccacgaccaactgcacctgctcagctgttcccgagacaacacactcaaggtcatcgacct

SEQ ID NO: 110459 - DNA, 1614 bp, Homo sapiens
  Payload ID: 1668
  Gene Symbol: ATG16L2
  Gene Name: autophagy related 16-like 2
  ENST ID: ENST00000534905
  CDS Start-End: 41-535
tgggcgggaggaacgcgccgctaggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcaggtacctgaatctctctcatccatggagtgtcaccattttctgaggctgaaagttcttccactagcaccgatgggaaaactccaatacgcccattgaattccccttcccagaagccatcatcatcttggttttctttgttcaagatacggattattgctccctcaggaaaagataactcatcatctgtctggccctcataatcataaagtgctttcacaaaacatactagggagcaagagaaaaacaaatctggtaagataattaacagccggttgcttttgcaaccacccctatgctcacatgacaactaaaagagcatcatacagaataggattaaagttgtaatttttttactcactgatgaatgattaactttagggttctactgtgcaggacaaacgtgaccatataaagaaaagcatattataggacaggaggaaagttgtgctttttatcctactgaaggcttactccagggcaatacagtttaggtcaaacgtgaccaaataaagagtgccttgtttcagtctttaccactggcatctccgttgaggctgcctgaaacgagttctgcttccgtggaattgctggacgtgtgtgaccgactgtccaaagcggccagggactgcagcatgctcaggaggctgttcgaggtgggaaactgtaggtacttttctggcacataacccacttggccaactttatttcgagcctgggtaaaagacatgtgacaaaacaagtttacacacacaatttagacagggcacaacaaagaccaaaacaaactcctaaaaatgtcacaagaaagggcgatatgagcaaaggaatatacctttacccagtcttccatatctccatcttcaatcacttctaacacctcatgttcctcaatggtcaactcatctggttgagaagcctgcagtgtaggatggtcatggacaaaattaaaaaggttagataaggagcagatgtgagctgatcatgacaaaaactggggatcaaaatattgaaatgattttgagaaacatgttgaacataaaaatttaaatgctgtaaaa

SEQ ID NO: 110460 - DNA, 1400 bp, Homo sapiens
  Payload ID: 1668
  Gene Symbol: ATG16L2
  Gene Name: autophagy related 16-like 2
  ENST ID: ENST00000540222
  CDS Start-End: 1-1192
cgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcagttttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctc

SEQ ID NO: 110461 - DNA, 1456 bp, Homo sapiens
  Payload ID: 1668
  Gene Symbol: ATG16L2
  Gene Name: autophagy related 16-like 2
  ENST ID: ENST00000538973
  CDS Start-End: 1-1251
gcagggaggagtcgggcctcgccggtgtctggaagggaggggggcagcagccgccccctggaggaagggaccgggtctagccccgcctgcgtgcgaggcgccgcgccagggtctcaggatgctttttacccaacaagggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctc

SEQ ID NO: 110462 - DNA, 3731 bp, Homo sapiens
  Payload ID: 1668
  Gene Symbol: ATG16L2
  Gene Name: autophagy related 16-like 2
  ENST ID: ENST00000544490
  CDS Start-End: 20-340
taggcgggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgagtgagagtggcagtaccagcctcctggtgtggtgaggatggaaggagcgtgtagcctgctgggaacatcatggcgcccgagggccggatgggcatttggcagcctctgcgcgaggagtcctcgcagtggttatgcatggtgctgggagcggagcgctggcttcccactcttcaggcgaggcagtggagcgggttgctcttgccagagaggttcctagtagggtcgcagagaaacgaagcggcacggcgaggattgggacccagggctgactccagagcccgagggccttccactgctccacaaacagcagcgcgtccctgtgcaaggtcccaaacctgtgtggggctcagcttgcttttcaggaagggggcgggcaggtgagcagccgactcccttagcgccttcggccccggagggactggaggcctggaggggcctcagcgccgccgtgcccacctgtccgcccccagatggcctaccaggtggtggagaagggcgcggccctgggcacgctggagtcggagctgcagcagaggcaaagcaggctggcagccctggaggcccgcgtggcgcagctgcgagaggcgcgggcgcagcaggcccagcaggtggaggagtggcgggcgcagaatgcggtgcagcgggcagcctacgaggcgctgcgcgcgcacgtcgggctccgggaggcggcactgcgcaggctccaggaagaggcgcgcgacctgctggagaggctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagtaagagtggggatgggccggtccgacccttgcgttctgcctcccgccccgcctgcctgcggcgacccaggctgccgactgtacttgtgcacagccccgtcctgaggcccccatgtggtcggagcccacgagacacctgcagaggaccgtgtggtcgtaggagcctgcatgcgtgaccgctgcacgtgtacacccacacagaaccctcatcactgggaattcctgtcttcagcgtatcctgtgctggggtcgggaggggctggcttggtcccttggcctttctgaacttcattacctctcctaggggcccggacaccctaggcgatgggatgagggagagaagggagactctggctctggcccctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctctggaatgttgtgggaagtcgcctggaggccaaccagaccctggagggagctggtggcagcatcaccagtgtggactttgacccctcgggctaccaggttttagcagcaacttacaaccaggctgcccagctctggaaggtgggggaggcacagtccaaggagacactgtctggacacaaggataaggtgacagctgccaaattcaagctaacgaggcaccaggcagtgactgggagccgcgaccggacagtgaaggagtgggacctcggccgtgcctattgctccaggaccatcaatgtcctttcctactgtaatgacgtggtgtgtggggaccatatcatcattagtggccacaatgaccagaagatccggttctgggacagcagggggccccactgcacccaggtcatccctgtgcagggccgggtcacctccctgagcctcagccacgaccaactgcacctgctcagctgttcccgagacaacacactcaaggtcatcgacctgcgtgtcagcaacatccgccaggtgttcagggccgatggcttcaagtgtggttctgactggaccaaagctgtgttcagcccggacagaagctatgcactggcaggctcctgtgatggggccctttacatctgggatgtggacaccgggaaactggagagcagactacagggaccccattgcgctgccgtcaacgccgtggcctggtgctactccgggagccacatggtgagcgtggaccagggcaggaaggttgtgctctggcagtagggccacgacctgcctgcctgggctggagctcttgcccgaagcctgaagcttccttcggcgccatgcaggggttggggttgggactggagctggccttgggatttaatggggaagaaggcctggcaggacctggcctgtttgtttaaaaatgaagtatgggttgggggattacgctagtttttctttgtatttttatctctatctcctcactttttctcccaaagtagaaaaaaatgatatctg

SEQ ID NO: 110463 - DNA, 537 bp, Homo sapiens
  Payload ID: 1668
  Gene Symbol: ATG16L2
  Gene Name: autophagy related 16-like 2
  ENST ID: ENST00000541999
  CDS Start-End: 1-297
ctcgtgcagcgcaaggcgcgcgccgcggccgagcgcaacctgcgcaacgagcgccgggagcgggccaagcaggcgcgggtgtcccaggagctgaagaaggctgccaagcggaccgtgagcatcagcgagggcccggacaccctaggcgatgggatgagggagagaagggagactctggctctggcccctgagccagagcccctggagaaggaagcttgtgagaagtggaagaggcccttcaggccccggctcagcttcccaggaacttttgttggtctgcctcagccacctccctgacgctgtcccactgtgtggatgtggtgaaggggcttctggattttaagaagaggagaggtcactcaattgggggagcccctgagcagcgataccagatcatccctgtgtgtgtggctgcccgacttcctacccgggctcaggatgtgctggatgcccacctctctgaggtcaatgctgttcgttttggccccaacagcagcctcctggccactggaggggctgaccgcctgatccacctct

SEQ ID NO: 110464 - DNA, 1492 bp, Homo sapiens
  Payload ID: 1668
  Gene Symbol: ATG16L2
  Gene Name: autophagy related 16-like 2
  ENST ID: ENST00000540567
  CDS Start-End: 1-353
gggagagcgcggccatggcggggccgggcgtccccggtgcccccgcagcgcgctggaaacgccacatcgtgcggcagctgcggcttcgggaccgtacgcaaaaggcgcttttcctggagctggtgccggcctataaccatctcttagagaaggctgagctgctggacaagttctcaaagaagctgcagccggagccaaacagtgtcactcccaccacccaccagggcccctgggaggagtcagagcttgactcagaccaagtcccatcactggtcgcactgagggtgaagtggcaggaggaggaggaggggctccggctggtctgtggtgaggtaagttgggaaggggtctgaaaatggggtagagagatgtggtccaagggagccagccagtgacgggtactcctgtgtttgctgaattctccaagcccagtgctgcaagcattgagtgagccctagtgtgtgccaggccctgacctgaagctgagcaggggtcagagtgccctgggcagcccaggatgaagtgggctccaacagcagctggagggagttaggtgtgcaagggcctggcagcccatttcccttccacatggtttagcctgctctgctcactactccatggctcacccctcgcccagccatccccaaggcctagcaccagttgatgctcaatatacatttgcagactacagaagttaggttcatttagcgcattggcagagtgtggacgctccacctgacactaccgccttccctgcccctttgcaacagtgtctcttggcttctctttcaccatgctctcctggtttccctctcatttctgtgattgttgcctctgaacttccttcactggctccttcccctcctccctattcctgtcccttcaaatgtgggtgttcttggggttcactgacccccgttttttctgtttgccaactctcagttctgtctctagccgagccttcttttctgagcttgactctcttgctcagctgctttttggagatcacatctaaaatcaggctcaccatctcccccagaatttggcccacaccgttttgagagttgactccttgcaggcatcgggctaaacattgtctcagttaatccttcacaactttatggttgtagaggaggaaactgaggcttggagaggtagagccaggatttgagcccttctcacacaaatcaacttctgtgctctccattcattctctcaacatctgttgacagttgctatatccaaagtacggggagtgcaacaataaacaagacctggccccatggggcttccagtcctctgaaagagactgtgatagcccaggaaatacacatccagtcacagaatggcaagtcacctgcccaacagaaatgcgggcataggtacggactcatttgagaacctttccctagagctgctgttgtaggtccaatttaatatttgtttgagaggtgattctcaaacatctgacccccacaccacccccagcctc

SEQ ID NO: 110465 - DNA, 6357 bp, Homo sapiens
  Payload ID: 1669
  Gene Symbol: ATG2A
  Gene Name: autophagy related 2A
  Uniprot ID: Q2TAZ0
  ENST ID: ENST00000377264
  CDS Start-End: 114-5930
ctggcgcctagagaagcggcggggcgagccgggggctctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggcctcatgcatgaccacaagcctgcagctggcccaggagtgtctgcgggatgggctaccggagccctctgagccaccacagcccctggaggggctggagatgtttgcccagaccattgagactgtgcttcggaggatcaaagtgaccttcctggacactgtcgtgagggtggagcactctccgggtgatggggaacgtggtgtggccgtcgaggtccgtgtgcagagactggagtactgtgatgaggcagtgcgggacccaagccaggcgccgccggtggacgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagccggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcca

SEQ ID NO: 110466 - DNA, 1481 bp, Homo sapiens
  Payload ID: 1669
  Gene Symbol: ATG2A
  Gene Name: autophagy related 2A
  Uniprot ID: Q2TAZ0
  ENST ID: ENST00000421419
  CDS Start-End: 85-1080
ctagtgaacagcggagccggacggggatcgccggcgggcggcaagcggaggcggcccaggcccggcggtctccgagatgtcacgatggctgtggccatggtcaaactgtgtgaaagagcgggtctgccgctacttgctgcaccactacttaggtcacttcttccaagagcacctcagcctggaccagctcagcctcgatctgtacaagggcagcgttgccctgcgagacatccacctggaaatctggtctgtgaacgaggtgctggagtcaatggagtcaccgctggagctggtggaaggcttcgtgggctccatcgaggtggccgtgccctgggctgctctgctcaccgaccactgcacagtgcgcgtgtccggcctccagctcaccttgcagccccgccggggtccagcgccaggggctgccgactcacagagctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcat

SEQ ID NO: 110467 - DNA, 5654 bp, Homo sapiens
  Payload ID: 1669
  Gene Symbol: ATG2A
  Gene Name: autophagy related 2A
  ENST ID: ENST00000418259
  CDS Start-End: 1-5227
gtactgtgatgaggcagtgcgggacccaagccaggcgccgccggtggacgtgcatcagccgcctgccttcctgcacaagctgctgcagctggcaggggtccgcctgcactacgaggagctcccggcacaggaagagcctccagagccccccttgcagatcggcagctgctcagggtacatggagctgatggtgaagttgaagcaaaatgaggccttccctggccccaagttggaggtggcgggacagctgggctccctgcacctgctcctgaccccgaggcagctccagcaacttcaggaactgctcagcgccgtgagccttacagaccacgagggcctggctgacaagctgaacaagagccgcccgctaggtgccgaagacctgtggctgattgagcaggacctgaaccagcagctgcaggcaggggcagtggctgagcccctcagcccagacccccttaccaacccccttctcaacctggataacactgacctcttcttctccatggctggcctcacaagcagtgtggcctcagccctctctgagctctccctctccgatgtagacctggcctcctctgtgcgcagcgacatggcctcccgccggctctctgcccaggcccacccagctggcaagatggcccccaaccccctcctggacaccatgcgccctgactcgctgctgaagatgaccttggggggtgtgaccctgaccttgcttcagacgtctgccccatcttccggaccacctgacctcgccacgcactttttcaccgagtttgatgccaccaaggatgggcccttcggttcccgagacttccatcaccttcgaccacgcttccagagggcctgtccctgtagccatgttcggctaacgggcacagccgtgcagctgtcctgggagctgcggacgggcagtcggggccggcggacaaccagcatggaagtgcacttcgggcagctggaggtgctggagtgtctgtggccccggggcacctctgagcctgagtacacggagatcctgacctttcctggtacgctgggctcccaggcctcagctcggccctgcgcccatctgcgccacacacagatcctgcgccgtgtgcctaagagccgaccccggcgctcagttgcctgccattgccactcagaactggccctggacctggccaacttccaggcggacgtggagctgggggccctggaccggctggccgccctactgcgcctggccaccgtacctgctgagcctccagccggcctgctgacagagcccctgccggcgatggagcagcagacggtatttcggctctctgcaccccgggccacgctgcggctgcgcttccccattgccgacctgcggcctgagccggacccctgggcgggccaggccgtgcgggctgagcagcttcggctggagctgagtgagccccagttccggtcagagcttagcagtgggcctggtcccccagtccccacccacctggaactcacctgctccgacctacatggtatctatgaagatggagggaagccacctgtcccttgcctgcgtgtctccaaagccctggaccccaagagcactgggcgcaagtacttcctgccccaggtagtggtgactgtgaacccccagtccagcagcacacagtgggaggtggccccggagaagggagaggaactggagctgtcagtggagagtccctgtgagctgcgggaacctgagccctcgcccttctcctctaagaggaccatgtatgagacagaggagatggtgatccctggagaccctgaggagatgaggacgttccagagccggaccctggcactgtcccgctgcagcctggaagtgatcctgcccagtgtccacatctttctgcccagcaaggaggtctacgagagcatctacaacaggatcaacaacgacctgctcatgtgggagcctgcagatctgcttcccacccccgaccccgccgcccagccctcgggcttccccggcccctcaggcttctggcacgacagctttaagatgtgcaagtcagccttcaagctggccaactgctttgatctcaccccagactcggactcggatgacgaggatgcccacttcttctcagtgggggcatcaggtggcccacaggccgctgcccctgaggccccaagtcttcacttgcagagcaccttctctacactggtgacagtgctgaaggggcggatcacagccctctgtgagaccaaggatgagggtgggaagcggctggaggctgtgcacggggagctggtgctggacatggagcacggtaccctcttcagcgtctcccagtactgtggccagccaggacttggctacttctgtctggaagctgaaaaggcaacactctaccaccgagcggccgtggatgactacccgctgcccagtcacctggaccttcccagtttcgctcccccggctcagctggccccaaccatctacccatcggaggaaggggtgaccgagcggggagcctcgggccgcaagggccagggccggggaccccacatgttgtccactgctgtgcgcatccacctggacccccacaagaatgtgaaggagttcctggtgacactgcggttgcacaaagccaccttgcgccactacatggccctgcccgagcagagctggcattcccagttgttggagttcctagacgtgctggatgaccctgtgctgggctacctgcccccgacggtcatcaccatcctgcacacacacctgttctcctgctctgtggactataggccactctacctcccagtgcgtgtcctcatcaccgcggagaccttcactctctccagcaacatcatcatggacacctccaccttcctgctcaggttcatcctcgatgactccgccttgtacctgtccgacaagtgtgaggtggagaccctggacctgcggcgagattatgtctgtgttttggatgttgacctcttggaacttgtgattaaaacctggaaagggagcaccgagggcaaactgagccagccactattcgagctgcgctgctccaacaatgtggtacacgtgcacagctgtgccgactcctgtgccctgctggtcaacctgctccagtacgtaatgagcacaggcgatctgcaccccccaccccggccccccagccccacggagatcgccggccagaaggtacagctctcggagagtcctgcctctctgccctcgtgccccccagtggagacggccctcatcaaccagcgtgacctggccgacgccctcctggacaccgagcgcagcctacgggagctggcccagccttcaggtggccacctccctcaggcgtcgcccatctccgtctacctattcccaggtgaacggagtggggccccacccccttcaccacctgtcgggggccctgctggcagcttagggtcatgctcagaggagaaggaagatgaaagggaagaggagggcgatggagacaccctggacagtgatgagttctgcatccttgatgctcccggcctgggcatcccgccccgagatggggagcctgtggtgacacagctgcatcccggccccatcgttgtgagggacggttacttctcacggccgatcggcagcacggacttgctgcgggcacctgcccatttcccagtgcccagcactcgggtggtgctacgtgaggtctccctcgtctggcacctctatgggggccgagactttggcccccaccccggccacagggcaagaactggcctctcaggtcccaggagctccccttcccgctgctctggccccaaccggccccagaactcatggcgcacgcaggggggcagcgggcggcagcaccatgtcctcatggagatccagctgagcaaggtaagcttccagcacgaggtgtacccagcggagccagccacaggccctgcggcccccagccaggagctggaggagcgaccgctgtcccgtcaggtgttcatcgtgcaggagctggaggtccgagaccggctcgcctcctcccagatcaacaagttcctgtacctacacacgagtgagcggatgccgcgacgtgcccactctaacatgctcaccatcaaagcgctgcatgtggcccccactaccaacctgggtgggcctgagtgctgtctccgcgtctcgctgatgcccctgcggctcaatgtggaccaggatgccctcttcttcctcaaggacttcttcactagtctggtggccggcatcaaccccgtggtcccaggggagacctccgctgaggctcgccccgagactcgagcccagcccagcagccccctggaagggcaggccgaaggcgtagagaccactggttcgcaggaggccccaggaggtggacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcctggggtgcccggcacccagagggtgctgcccaccatgctcctgagcctcccaagagctgcagcccacgggcccggcccggcctggcccttcaggggatggccactgtgaaggacgccttcccagcctgcccgttgccaatctgctgtgagaggggggcctccctgccttggggccttagccctggctctgcacttttcctccggggagaaaggacactgcccctcccccgacctgggcccacactgctgccttctcccaggacggaggcttttggaccctcggaccccatcccactcagccaagtgtctttctgtgtctggggggaggaggggatgatatccgtgtggttcgatgtattatttttaagctccgtgagtgcgtgggtcagtgtctgcatgaagtggaataaactgcccaccgcca

SEQ ID NO: 110468 - DNA, 13684 bp, Homo sapiens
  Payload ID: 1670
  Gene Symbol: ATG2B
  Gene Name: autophagy related 2B
  Uniprot ID: Q96BY7
  ENST ID: ENST00000359933
  CDS Start-End: 895-7131
ggtgcgggcggggatgctcgagaagggctccagtcctcccagcggagacggcggagccccaagtgtgcgtttccggggcgccgaggtctgaggggagccgggagagccaggccggccagaccggcccccagacccctcttaacacgggcgcggggcccctgcagcctgccgcccctctcggcccagccagctgcatggcgtcgcgtccccatccggaaggcctgacggcccgccggcgccccgagcccctagcccttctcgggggccgcccctcgcccgcagccaccccggctgccgctcacctgcgcgcccggcgtcctcttcttccttcctccggaggcgactggagccgaccggcggtgccgccccctccctccccgccttcttccgccccgccccctcggagccggaactgctccagcccccgcccttctgcccgccttccgcggccccagtgtggcgtcacttccgccagcgcccggcggcgcgccgggagtctgggtctcgtgaacgcgccaggagcgtccctacagccgggaacgcgcctcgcggatgacaacaaattcgtcgcgcggcggcagtggcggtggctgcctcagcccctgccgcctcctctcgcgctctcttgcactctctccgagccggttgggaccctcctcggaagtcccctggcctggggccaggaggacccctctgcgtcttgcctccgccaggcccagcgcgagcggtgcggcgccggcgatggggtctccctgagggactcccggcaccaaatagggatggaggggccgccccaggcttaggccccgccgcggcctggagccggagtcgctaccccgaggccggagccgtcgcaacccgcagccgcagtcagcccagctgccagcagtcactatgccttggccgttttcggagtccatcaagaagagggcctgccggtacctcctgcagaggtacctgggccactttctgcaggagaagctgagcctggagcagctcagcctggacctgtaccaaggcaccgggtccctcgcccaggtccccttggacaaatggtgtctcaatgagatcttggagtcagcagatgcacccttagaagtcactgaaggattcattcagtcaatttccctgtcagttccatggggctctttactgcaggataattgtgcactggaagtgagaggattagaaatggtcttccggcctagacctcgcccagcaactggttctgagcctatgtattggtcaagttttatgaccagcagtatgcaattggcaaaagaatgtcttagccagaaactaacagatgaacaaggagaaggatcccagccttttgaaggacttgaaaagtttgctgaaaccattgaaacagtactaagaagagtaaaagtcacttttatagatactgttttgagaattgaacatgtgccagaaaattccaaaactggaactgcacttgaaattcgaatagaaagaactgtgtactgtgatgaaactgctgacgaatcctcaggaattaatgtgcatcaacccactgcttttgctcacaagttacttcagctctctggagtgtctctcttctgggatgagttttctgcatcagccaaatcttccccagtgtgttcaactgcaccagtggaaactgagccaaagctctcacctagctggaaccccaaaattatttatgagccacacccacagctaactagaaatttaccagagatagcaccttctgacccagtgcagattggacggttaattggtaggttggagttgagtctcacgttgaaacagaatgaagtgcttcctggagctaagttggatgttgatggacagatagactctattcatctactcctgtcaccaagacaggtgcacttgcttttggatatgttggcagctattgctggaccagaaaattctagcaaaatagggttagctaataaagataggaaaaatcgacccatgcagcaggaagacgagtatcgaattcagatggaattaaaccggtattatttgagaaaagattccctctctgtgggtgtatcttcagagcaaagcttttatgagacagaaacagctcgtacaccttctagccgtgaagaagaagtattcttctccatggctgatatggacatgtctcatagtctctcttctcttccaccccttggggaccccccaaacatggaccttgagttatcattaactagtacatatacaaataccccagcaggatctccattaagtgctactgtgcttcagcccacttggggagagttccttgatcatcataaagaacagccagtaagagggtcaacatttccatccaacctagttcacccaacacctttacagaagacatctctcccatctagatctgtttcagtggatgaatcaaggcctgaacttatttttagactagctgtgggaactttttcaatctctgtgcttcacattgatcctttatctccacctgaaacgtcacagaaccttaatccattgacacctatggcagtagctttctttacttgtatagaaaagattgatccagcaagattttcaacagaagattttaagtctttccgagcagtgtttgcagaagcttgctcacacgatcaccttagatttataggtactggcattaaagtatcctatgaacaaagacaaagatcagcttcccgatattttagtactgatatgtccattgggcaaatggaatttttggagtgcctatttccaactgattttcattctgttcctcctcactatacagagcttttaacgttccattccaaagaagaaactggttcccattcccctgtgtgtcttcagcttcattataagcattctgagaatagagggccccagggtaatcaagcaagacttagttcagttcctcacaaggcagaattgcaaattaaattaaatccagtgtgttgtgagctggatatcagtattgtggacaggttaaattccttgcttcaaccacagaaacttgccacagtagagatgatggcatcccacatgtatacttcatataataaacatattagtctgcacaaggctttcactgaagtgtttctagatgattcacatagtcctgcaaattgtcggatatcagtacaagttgccacaccagcattaaacctttctgttcgcttcccaatacctgatcttcgatctgatcaagaaagaggaccatggtttaagaagtcacttcagaaggagatcctttatttagccttcacagatctagaatttaagactgaatttataggaggatcaaccccagaacaaattaaattggaacttacctttagagaactaattggatcgttccaggaagagaaaggagatccatctattaagtttttccatgtgtctagtggagtagatggagatacaacatcgtcagatgactttgactggccacgaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacagatggtgatgccaggagaccctgtagaaatgacagaatttcaggataaagcaatcagcaattctcactatgtgctggaacttacgttaccaaatatttatgtaacactacctaataagagcttttatgagaagctttataataggatctttaatgacttgctactgtgggaaccaacagctccttcaccagtggagacattcgagaatatttcctatggcattgggctttcagtagccagtcagctcattaatactttcaacaaagatagttttagtgcatttaaatctgcagttcactatgatgaggaaagtggatctgaggaggagactttgcagtatttttccactgttgatcccaactatcgttctcgcaggaaaaaaaaattagactctcagaacaagaactctcagagttttctctcagttcttctgaatattaatcatggattaatagcagtgttcacagatgtgaagcaagataatggagatctgttggaaaacaagcatggtgaattctggttagagttcaatagtggttcattattttgtgtgacaaaatatgaaggttttgatgacaagcactacatttgccttcattctagcagtttcagtctgtaccataaaggcatagtgaatggagtgattctcccgacagaaacacgacttcccagctcaacccgcccacactggttggaacctactatttattcctctgaagaagatggcctcagtaaaacttcttcagatggagttggaggagacagtttgaatatgctgtctgttgccgttaaaatattgtctgataaatcagagtccaatacaaaggaatttctcattgccgtaggactgaaaggagccactctccagcatagaatgcttccttctgggcttagctggcatgagcagattttatacttcttgaatattgctgatgaacctgttttgggatataatcctccaacttcatttacaacttttcatgttcatctttggagctgtgcacttgattatagacccctttatttgccaatccgatctcttcttaccgtggaaacattcagtgtttccagtagcgttgcattggataaatcttcctctactctcagaataatcttggatgaagctgctttacatctatctgacaaatgcaatactgtcactataaatctgagtagagattatgttcgtgtgatggatatggggcttttggagttaaccataactgcagtgaagtctgattctgatggagagcaaactgagccccgctttgagttacactgttccagcgatgttgtccatatcagaacgtgctcagactcttgtgctgcgttaatgaatctcattcagtacattgcaagctatggtgacttgcagacacctaacaaggcagatatgaagcctggagcctttcaaagaaggtctaaggtagattccagtggtcgatcatcctcacgtggtccagtacttcctgaagcagatcaacaaatgttacgagatctgatgagtgatgctatggaggagatcgacatgcaacaaggcacctcgtcagtaaaaccacaggctaatggtgttttggatgaaaaatctcaaattcaggagccatgttgttcagacctcttcctgtttcctgacgagagtgggaatgtatcccaggagtccggccccacctatgcctcattctctcaccatttcatcagtgatgcaatgacaggtgtgcccactgagaatgatgacttttgcattctttttgcaccaaaagcagccatgcaggagaaggaagaagaaccagttataaaaatcatggttgatgatgcaattgtgataagagacaattatttcagtctgcccgttaataagaccgatacgagcaaagcccccttacactttcccattcctgtgattcgctatgtggtgaaggaggtctctcttgtctggcatctttatggaggaaaggattttggaatagtccctcccacttctccggctaaaagttatattagtccccacagttcgccttctcacacacccacgagacatggacgtaatacagtatgtgggggaaaaggaaggaaccatgactttttaatggaaatacagctaagcaaggtgaagtttcagcatgaagtctacccgccatgcaaacctgattgtgattccagcctctcagaacacccagtctcccggcaggtgttcattgttcaggatcttgagattcgagatcgtttggcaacatcacaaatgaataaatttttatacctgtattgcagtaaagaaatgcctcgaaaagctcactccaacatgttgacagtgaaagccttacacgtgtgtccagaatctggcaggtccccacaggagtgctgcttgagagtgtcgctgatgccgctccgcctcaatattgaccaggatgctttgttcttcctgaaggatttcttcacaagtctttctgcagaagtagagcttcaaatgactccagatccagaagttaaaaagtctcctggagctgatgtcacctgcagtttgccaaggcatttgagtacctcaaaggagccaaatctggttatttctttctctgggccaaaacagccttcccaaaatgatagtgccaattcagtggaagtggttaatggcatggaagagaagaacttctctgctgaagaagcatcttttagggatcagcctgtgttttttagagaatttagattcacgtcagaagttcccattcgacttgattatcatggcaaacatgtatcaatggatcagggtacgctagctgggattttgattggtctggctcagttaaactgctctgaactaaagctcaagaggctttcctatcgacatggtttactaggcgttgacaaattattctcatatgcaatcactgagtggcttaatgacattaagaagaaccagctaccaggaatcctgggaggtgttggacctatgcattcactagtacaattagtacaaggcctaaaggacttggtctggctcccaatagagcagtaccggaaggatggccgcattgtcagagggtttcagagaggcgctgcttcctttggtacctcgacagcgatggctgctctagaactcacaaacagaatggttcaaaccatacaggcagctgcagagactgcttatgatatggtgtctcctggtaccctttctatcgagcccaagaagaccaaaaggtttcctcatcaccggttagcccaccagccagtagacctgagggaaggtgtggccaaggcctacagtgttgtgaaagagggaatcacagacacggctcagaccatttatgaaactgcggctcgagaacacgagagcagaggggtgactggtgccgtgggcgaggttctgcgccagattcctccggcagtggtgaaacctctgattgttgccacagaagcaacgtcaaacgtgctgggtggcatgagaaaccaaattaggccagatgtccggcaagacgagtcacagaaatggcgccacggggatgactgatggcttggaactgacagtgtgaagataaggagagtggaaccaggagctcagagtcctgacagcagcttcagaggaagctcgtttaattttattgtgctcatctcaggaacaaaagcattttttagttaaataatttaacatcaaaacaacatgcaaccaaaaacttctgacatttatagttgatacttgcctatagaaatgtttggtggctggtgtcaaaggtccttaaagcatttgctgccaagttagtggaaggctcacttttgttaagatgactgtaattctccttgttaccgacgagagatcattggaagctgccttctaacactttgtgtagctctgtggagttggattttcttaaggtttaaaaagaatcacagcttcggaacttttaactgaaaatgagagacagaagccacaggggaagcaaagcaaataggattttcaatataaatatcagtgtggaaaaataacctattctgttgaatttagtgttcatgcacttgagaacaacattatttccatttactccgaaaatccttctgtgggggtttgagaaagtgaatgttgcagacatgttctgttgtgttgcactttatcctgtgtttatgtgtatgtgtttttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccatgtaattgtttatattttcagttttaagcaggtatagtgcaggcttgttaggaatgtgtggaagggaagattggaagtgatttttcctcttttaaaagtaaacaaaattcttcaaatatgccctagttaactatttcagcataccatttttacttggttaacagtgtacattttgataacctatcaggaatgaataaagtatttttatttaaaggtgatattgttttatgcttccatgaatattttgcttttcttagagcatattcatagatgcagtactgtgatttaccacaagataattgggaacactttctcaaaatcgattttggttaatatcaggtaaatcattacctaggagtaagagggaaattgttgtcaattcctgactttagattgatccagcagaaagaaaaggtggaactttgtatatatccactgttgaaagttgcatgacctgacttcctgttttctaaagttgggggaatattattgaacttcaatttcagaactgcatttcaatttggggcttggaaaatgtagttaaatcaatttcgttctctaaattttctaagcaggaaagcaatgtaaaccaaaaatcaaaatgtttagaatttataaaaatggggttatatagcttttaattttagtttcctttttactgccaaaaaacttaaaaagacaacagcgtaaccacctgtttaagcaccgtgggaccatctcttattcgggtagagcctggtcctggcgacacactaacaggaaggcgtgctgtgttaccgggaaggcgcctctggctgtggggtgcgttctgaccaccccgctcagatgccagcattttccatttgcccttaaggaaacttgctatgtgtgttaacccagttatgattagtcaaactggaaaacacttgatcaaacttaaaattgtaaaatctgtctaacttttaaatatactttccacagttgtacttaagttcaattaactacagtatagagaaaaataattattctcttctttgcacccggagttgcaaacaaattaagtttacaaatctcatttaaacatatatctttgtaatgtaatctccgcggttctttctttgttctaccctcctgcacctgttgtcgatgtaatcattttgggaacagaaacgttgtgtctcaaaaagattcgttgtcagttcagccaagatgttctttacctgagattctggaaagatgtttatctatatcggaacacttctacattattaaatgtccttaagctttttcttttttacaagtgtcttttcagactttggtgttgtgatgacacagtagaaagagcgtggctagaatccgtggtttgccacatctgcagcttaccaaacggatgacttgtccaggacatctgatccctgtaagcctcagcatccctcctggtaaatggagggttttttacgacaaagcccaaagggaggttttggatgattaggctgtgtgtgcgtgtgagaatgatcacatgtggcgtcatgctttgtacagagcctcagaccactgggcctcgtccagtgagagtcctctctggcgacatcacacgcggagcagccaggggccaccttagatctcagatctctcagagcaatacttttctgaactgccactgtgcctgggtggttgggttggtgtcatgcttctgactagagtagatcgcgcatgtccaccagtgatacgttgagtccttacagttccccccatggagtcccataagcagctccatcgagatctgtcagcaagttgcaggaccccacaatgttctgacatgttaagacccccttacatgacgagtagagaggcagctgaggccacaaccgtgtcttcctcttgaatggagctaactcggaaccccccgttttctcttcctttctgcccaccactgaacattgccttttagataactcagtgtttcttctagatgtcatagcaatagactttcactttcatgaagtttgggtacgatttggattctcgcttaagtacatatatttatcaatatttttataaggcaaagttcacttaaaaaatctttccaagtagcagtgtgcctaagatggcaaaatactaaaaactggtgtttcctgctcctgttgtgtgtcacttttcaagccgattgaaatatttctggcttttagggcattactttttaactatctcctttaaaaacgatgttctgtaggtttagtgtctttgttcatttccaaaagagtccagacaactgtgtctgcccctgcagaggctgtttgtccaaaggcagcatgccgcttccaccggaatgcagacagcaggggagcggaattctaaagcagcgacttaaaatgaggaatccccaattgcactaaatggtttcaggattgactaatcattgtcttaacattaactcagattttcaatgtgtaaagagctgtgtgacttggcgtctgagagatccctctgctttgctttgcttcagagtcctcgcacccgcatcctcagaactgtggggcatggtgggctctaacgagcactccccttctgttttccttcattacttttgacctccttaagacttcagagagaatgtccgtcaagttcttttctccatcaagttctttaagttccttgaaaggaagggactgtgcaaacacaaagcaatattcttttgtatctgcaaatgcatcagctggacataccaattggtatcaaatagaataaaatcaaatataaatgtttgagtcttaggttaaaaaggaaggttatttgtatagtttatagataatgaaggaaaaatttctttttcattgcaggaaatcttgtttactggaagatagagtcactcttttcatataagacaaatagtgctttaatgccaacttctttttatctcaacatttcaggatcatgctaggcacactgcccccttgaatagacattatatgcacagttgcaagtcagccaatgtttttattcagaagtatttccccccattatagtgcctgcatatcagagatacaaaaagcatccaacacactaccgtaataggcttctttggggatgagaaatttgagtctcaacaactcagagtttgagatgtcagcttttttggtaaacgtaggtgttagaggtatattttgctttcctacaacaattgttggcccttgatttcaagcatgttgcttcataggaagcaccagagtgccatctgctgcatttcaagagattgtaaatgtcatctcagctggctcagttatatctctaatgtcccgggtagcagcacctccctctaaaaatatgtttacttcactgtttcacttgtattttgtgtatacgaaatggcagcttccgatttctagttggatttgtcttgcattgtttgtataacttgctggtcacccagggctatttgctttttcattgagaaatttggtaggggtgtctagttcagcttttatgttgatccatcctgacttattttagacattgaatttatctcaccacaagtaaaagaacatgtgtattgactgtctttgctaagtttcctaatttttcctaattatggcaattatggatgtgaataagaatactgatgctgtacaaatatttttgtggaaatgtaccttgttaatgtgactatttaaataatatgaaaataagaatactcttgaagaaaaaattaaaatatttactctttggattttgctttaaacacttgtctttcaccaagaagtgttcccaaaacttgtgtaaaatacttattggggtggggtgtacatctgcctcagaccttgttattgggaaatgatgttccagtgcccctgatgcttctgatagcagatcttgggtctgtctgctactgattgctgagctgtatggagttttaacagttcttccctccctgctttggattttagtccctctattagttatcctatccctgcaataaggacttgcagcaaacacacctcctagtttgatatcacgaaactgataactatttggaggagtatttttacttatgaagggaatatttaaaagacatacttatttttattttatttatttattttttcagacggagctttgctcttgttgcccaggctggagtacaatggagcaatcttagctcactgcagcctccacctcctgggttcaagcgattctcttgcctcagcctcctgagtagttgggattacaggcacctgccaccacgccccacaaattttttgtttttttagtagagacgaggtttcaccgtgttggccaggttaacctcagcctggtctcgaactcttgacctcagcctccaaaaatgctgggattacaggcatgagccaccgtgcctggccagacatacttatttttaagggcaatttactttaaaagattttgttgtgacagatgtgactatataacatccactttgaacaattagggaaaaaatgacaagtcacacttcacccatggctcttgttgaaaaaagggatggggacaattgtgagatgcttactgtgtgccaagtatcctactgtctttttataatttcacagcccccactcagaggcagttactagagtccctgttttccagatgaggagacaggttcagagaggtcaagaaacttgctcaccgtcacatggtttgacttccagacctcatgctcttcccaggacttcatttaagaaaagcttggagcagttacctaacttagcaaaaagtcttcactaattgggaaaccacagaattttgctagaagattgagattaaaggctcttagaatatttgagcaagaaaatgtgcttgatctcttcctggcgtctccagcccctctcccctcttctggctgtgcttagccaccccagcggttcagttctgcatgcccgtgagtaggggttagcaccacctggaagatttctttctataaatgctgcaccacaggccacagtcaacactgattaaagcaaaatctcagaatggggctaaagtcgggtttctccacctcagcagttgacatttgggaccagcctgtgcattgtaggatgcaggggatgttgccaccctcccaccccccgctggcctctggccactggatgccagtaacaaactcccctcccccagttgtgacagccaaagacgtctccagacatggccaaatatgccaaatatgacaaaaatcccctgttaaaaatcactgggctaagagctctcctggggaaaatcatgcacagcctggggcaagaacgcgctatggccgccccaactcggatgctctgtcgggatctctggctgctcctgctgtctcagcccggaggctccacttcaggcagcctggccaccctcccttcctctctgtttcccactatagcatgctttccttttttttgtttgttaaactttgcggcactccccgcatactgtagatccacgtctgtttccctgtttgacttccttcaggagggcaagggacttagggacccggtgcctagcacagtgccttgcccagagtcagggatcagcaaatggtgaatgagtgaatgaatgaatgaatgagtgagtgaacccgagtggtcatctagtcctgtctgcaggtgaggaaatcgaagcccggagaggggaaattctttgcccaagatcacatgattactacttacagatgtcctttattcaatgtaagctcacgttttcttgattttagcaatacttgtaataatttttaaaatataaatatatatgaaataaaagttcatcattga

SEQ ID NO: 110469 - DNA, 1570 bp, Homo sapiens
  Payload ID: 1671
  Gene Symbol: ATG3
  Gene Name: autophagy related 3
  Uniprot ID: Q9NT62
  ENST ID: ENST00000283290
  CDS Start-End: 436-1380
tagtgtcacgtgaggccccggtggcggcgcagctacggcaagagagtgagaaggaagggaagccggaaggggcgcgagtgaagcaaagcgaggacagacagctcgcagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagagag

SEQ ID NO: 110470 - DNA, 3010 bp, Homo sapiens
  Payload ID: 1671
  Gene Symbol: ATG3
  Gene Name: autophagy related 3
  Uniprot ID: Q9NT62
  ENST ID: ENST00000402314
  CDS Start-End: 389-1324
gagaaggaagggaagccggaaggggcgcgagtgaagcaaagcgaggacagacagctcgcagagggcgaggggtgcgtgtgcgtccgcttctcacctcaggtctcccttcggccccgctgccctccctcgcggctgggtgacagctgggtccggtccgtcgcgggctgcctggggtgcgaggatcgcgcaccccgtcttcgcgcgctgtgcctgccgccccgccccctcgtcccgcccgtcccgtcgcgtcgcgtcccgtcccctcgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgagcaacggcagcctttaacagttgagcacatgtatgaagacatcagtcaggatcatgtgaagaaaacagtgaccattgaaaatcaccctcatctgccaccacctcccatgtgttcagttcacccatgcaggcatgctgaggtgatgaagaaaatcattgagactgttgcagaaggagggggagaacttggagttcatatgtatccttccctgtatgtaagattagtggcaaaatggctgttaacgattttttttttgagaaatttagtgtaaccttaatgatacagtagctataacttgttttaacttctcatctgaaaatcctagtagaagtctttcatttatttagaaaatgttatattgtgatagttatgccttgcttagttgattagaacatgtccccatgtgtagcagtagctcacccttgttacagaggtaactactaatttagaataataatatgagtatctttttcttatgtacatttccagtttaacatgttaccaaaaatgtactttcccatcaggtaaaagtaaaattaggttgtgtcaatctgaggtgtctctgaagcaaataattcagcttaaacaaatacgttaattaaaagtaatgtactacgtgaagtgctttagatattcttaaaatatagtacgttcatttttctcaagacagtagcacctttcttgtatcttactatagttttcctactcagttttcttggattgacaaaagtaatacattcaagttaatgcccaagcaaactgttggatcctaaagtacatgtactcatagcatagatttatcaaaaacagtcaaaatcaatgatttacatgccagatagcttgaattagtttgatgctaggttaatacttgacttggtggtggtttcggctactatgtgttagattagatgtggagactaagatgccacgtctaatcagactgtggggcattgctaataaagtgtgtccctaagaagaactttgaactgatttgatattgaaacaaaccaaaaacttccagtccaaaccatatttactcctgaagtcctattatgcctaactggcacatctctgctggatgctaggtagcaacttggaagactgtctatatataattcataatagtaattggtttcccccaatgaaaagtaagctcctaatgtttttaagtgcaatgaacataaaaaaatttcagaatttaattaaagacagtccagtagagctcagtctttggcaaatacatacactaacctagaatcagtctactatacaggatttttatttaatttttttctcttttgctatagtacttcattatagtctattctgcctcattttctgacataactctagcaaacttaaaggagtctagtaaatgagtacattttgtactcatttaaacatgtatagctttgtcctttttatgtcaaagtaattgtgcttatatgaacacctactcattaagaagtttcaaattcaataatcgaatgagtggtcaggtagtcttaaagagcctcatgttaaatagacacaaatttgcatagttgaattctttaatagacttaatttaagattttgtggggtttttttgagaaattaatggcttaataaaatggataattacaacatgggcttaaaacatagaactatttacaaatcttattttccttagctaaaaacctttaggtatcttcttattttcttgaaatttgtacaagctgtcattccaacaatagaatatgactacacaagacacttcacaatgtaatgaagagagcataaaatctatcctaattattggttctgatttttaaagaattaacccatagatgtgaccattgaccatattcatcaatatatacagtttctctaataagggacttatatgtttatgcattaaataaaaatatgttccactaccagccttacttgtttaataaaaatcagtgcaaagaga

SEQ ID NO: 110471 - DNA, 737 bp, Homo sapiens
  Payload ID: 1671
  Gene Symbol: ATG3
  Gene Name: autophagy related 3
  ENST ID: ENST00000496423
  CDS Start-End: 125-349
cgggtgctgccagccgggtgctgatgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcggtgaagatgctattttgcaaaccagaacttatgacctttacatcacttatgataaatattaccagactccacgattatggttgtttggctatgatgag

SEQ ID NO: 110472 - DNA, 639 bp, Homo sapiens
  Payload ID: 1671
  Gene Symbol: ATG3
  Gene Name: autophagy related 3
  ENST ID: ENST00000492886
  CDS Start-End: 391-639
gtgttacgcttccggaaggaggggagaagcggcttatcccgccccagcccggcccctttctcacgtcacgtgccgggagagtctagtgtcacgtgaggccccggtggcggcgcagctacggcaagagagtgagaaggaagggaagccggaaggggcgcgagtgaagcaaagcgaggacagacagctcgcagagggcgaggggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaacaatttttggtaaccaaaaatgtgccgtgctataagcggtgcaaacagatggaatattcagatgaattggaagctatcattgaagaagatgatggtgatggcggatgggtagatacatatcacaacacaggtattacaggaataacggaagccgttaaagagatcacactggaaaataaggacaatataaggcttcaagattgctcagcactatgtgaagaggaagaagatgaagatgaaggagaagctgcagatatggaagaatatgaagagagtggattgttggaaacagatgag

SEQ ID NO: 110473 - DNA, 2129 bp, Homo sapiens
  Payload ID: 1672
  Gene Symbol: ATG4A
  Gene Name: autophagy related 4A, cysteine peptidase
  Uniprot ID: Q8WYN0
  ENST ID: ENST00000345734
  CDS Start-End: 160-1170
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 110474 - DNA, 1941 bp, Homo sapiens
  Payload ID: 1672
  Gene Symbol: ATG4A
  Gene Name: autophagy related 4A, cysteine peptidase
  ENST ID: ENST00000343524
  CDS Start-End: 18-713
aggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 110475 - DNA, 2315 bp, Homo sapiens
  Payload ID: 1672
  Gene Symbol: ATG4A
  Gene Name: autophagy related 4A, cysteine peptidase
  Uniprot ID: Q8WYN0
  ENST ID: ENST00000372232
  CDS Start-End: 160-1356
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 110476 - DNA, 2501 bp, Homo sapiens
  Payload ID: 1672
  Gene Symbol: ATG4A
  Gene Name: autophagy related 4A, cysteine peptidase
  ENST ID: ENST00000372246
  CDS Start-End: 44-187
agtcaagttgccggtggaattggcccaggatgacagctggagaatggagtcagttttatccaagtatgaagatcagattactattttcactgactacctagaagaatatccagatacagatgagctggtatggatcttagggaagcagcatctccttaaaacagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaaggaaattctaaaggagaatttaaggatgtttgaattagttcagaaacatccatcacactggcctccctttgtacctccagccaagccagaagtgacaaccactggggcagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 110477 - DNA, 935 bp, Homo sapiens
  Payload ID: 1672
  Gene Symbol: ATG4A
  Gene Name: autophagy related 4A, cysteine peptidase
  ENST ID: ENST00000394892
  CDS Start-End: 1-935
ttttatccaagtatgaagatcagattactattttcactgactacctagaagaatatccagatacagatgagctggtatggatcttagggaagcagcatctccttaaaacaggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggaccctcatacaacccagacctttgttgacactgaagagaatggaacggttaatgaccagactttccattgcctgcagtccccacagcgaatgaacatcctaaacctggatccttcagttgcattgggatttttctgcaaagaagaaaaagactttgataactggtgtagccttgttcagaag

SEQ ID NO: 110478 - DNA, 939 bp, Homo sapiens
  Payload ID: 1672
  Gene Symbol: ATG4A
  Gene Name: autophagy related 4A, cysteine peptidase
  ENST ID: ENST00000457035
  CDS Start-End: 333-939
cgaccgtccgtccgtagtcaagttgccggtggaattggcccaggatgacagctggagaatggagtcaggtacggggagcggctttgagtggaaccgtgtgaaagagccgggttttatccaagtatgaagatcagattactattttcactgactacctagaagaatatccagatacagatgagctggtatggatcttagggaagcagcatctccttaaaacagaaaaatctaagctgttgtctgatataagtgctcgtctatggtttacatacagaaggaaattttcaccaattggtggaacgggcccttcatcagatgctggttggggatgtatgctacgctgtggacagatgatgctggctcaagcccttatctgtagacacttgggaagggactggagctgggagaaacaaaaagaacaacccaaagaataccaacgcatcctacagtgcttcttagatagaaaagattgttgctactctatccatcaaatggcacaaatgggtgtaggagaagggaaatcaattggagaatggtttggaccaaatacagttgcacaggtgttaaaaaaacttgctttatttgacgaatggaattccttggctgtttatgtttcaatggataacacagtggtcattgaagatatcaaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagagtgttttaagatgccacagtctttaggggcattaggaggaaaaccaaataacgcgtattatttcataggattcttaggtgacgagctcatcttcttggacc

SEQ ID NO: 110479 - DNA, 1566 bp, Homo sapiens
  Payload ID: 1673
  Gene Symbol: ATG4B
  Gene Name: autophagy related 4B, cysteine peptidase
  ENST ID: ENST00000344376
  CDS Start-End: 1-230
cagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgt

SEQ ID NO: 110480 - DNA, 663 bp, Homo sapiens
  Payload ID: 1673
  Gene Symbol: ATG4B
  Gene Name: autophagy related 4B, cysteine peptidase
  ENST ID: ENST00000400771
  CDS Start-End: 6-663
ggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagataggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttg

SEQ ID NO: 110481 - DNA, 625 bp, Homo sapiens
  Payload ID: 1673
  Gene Symbol: ATG4B
  Gene Name: autophagy related 4B, cysteine peptidase
  ENST ID: ENST00000400772
  CDS Start-End: 90-356
attggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattgccattcatcattgttgtataccctggagctggaaggagatggggactggttctcagccttgcctctcaccggcggagaactgaggccggaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcg

SEQ ID NO: 110482 - DNA, 3294 bp, Homo sapiens
  Payload ID: 1673
  Gene Symbol: ATG4B
  Gene Name: autophagy related 4B, cysteine peptidase
  Uniprot ID: Q9Y4P1
  ENST ID: ENST00000405546
  CDS Start-End: 503-1645
ctcgccagccgcgggttcgggcgtcttcggaccagcggggcgccgcaggcccctcgcagcgtccgtcggcaggcgggcagacgggcgggggagtcgccccggcggggcaagtccgtaccgcgacatgggcgcgccgagcacgtccgtaccgcaagatggctgctcggacggggacagagctcgcctctgccgcctcgacaactgctcctgggtcctctaagaggaggaagcgccacccatggcacacagtgtcccgtcggacagcagaaccagccgtcgtcccacgacacgaccccatgccgcccgcagggcgccccggggctcgcgtcggcccggccgtacgccaaaatggcggctcccgcgtatttccgctcgcgcgccgtatcgtcttcgccgcctgcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctaggtgagagctgccaagtccagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaac

SEQ ID NO: 110483 - DNA, 2878 bp, Homo sapiens
  Payload ID: 1673
  Gene Symbol: ATG4B
  Gene Name: autophagy related 4B, cysteine peptidase
  Uniprot ID: Q9Y4P1
  ENST ID: ENST00000404914
  CDS Start-End: 104-1285
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtcagacacagacatgaatttctgggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtgggcggcctgggcagaagggcggctggctgtcctggagctgctgctggagcctgccctcagagtgtccctttccagtgctgtggcattctgtggcagcttccccaggtgtggtgacggggggggggcggggcctccacctgtgacagccaggcttgagggtggacggcgtgcctctcccaggagccttccccatgtccttgccttgctgagaattgccctcccatgccgctgaggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccgctgctctgctgcctgtcctgggaaagtatctttgccccactaggaaatgtaaacaggagggcttggggagcgtgggcacttttctcatgagcagctactgcggcgttggcaggactcgctgctgctgctgctgcttgtgtaggtcggggagccagagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccacgtccgagttcatggtgcgccgctgtgctgggagctgcagtggtaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaa

SEQ ID NO: 110484 - DNA, 1685 bp, Homo sapiens
  Payload ID: 1673
  Gene Symbol: ATG4B
  Gene Name: autophagy related 4B, cysteine peptidase
  Uniprot ID: Q9Y4P1
  ENST ID: ENST00000402096
  CDS Start-End: 326-1321
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagccttcacatctggcctgccccgacgtcctgaacctgtccctaggtgagagctgccaagtccaggtggggtccctcggagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagtgttctctcgacactgccagccccgtgttagcacctgggcctcagtcccacttgctcccaggcgccggttctgtggttggtttggaattaaagtcctgtttgaagttgtc

SEQ ID NO: 110485 - DNA, 356 bp, Homo sapiens
  Payload ID: 1673
  Gene Symbol: ATG4B
  Gene Name: autophagy related 4B, cysteine peptidase
  ENST ID: ENST00000415107
  CDS Start-End: 6-272
ggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattgccattcatcattgttgtataccctggagctggaaggagatggggactggttctcagccttgcctctcaccggcggagaactgaggccggaggaggttgtcgggacatttcactctccagtaaatgtggcccttggcgttactgagtcctaagaggggggacaggccc

SEQ ID NO: 110486 - DNA, 553 bp, Homo sapiens
  Payload ID: 1673
  Gene Symbol: ATG4B
  Gene Name: autophagy related 4B, cysteine peptidase
  ENST ID: ENST00000419606
  CDS Start-End: 355-553
agtcggcggccggactgggaagatggacgcagtaaccagtagattctccaagctgcttttccgtgacgagaaagagaaacagtgaatttgtatcatcgggtcttagtttcttggggtcctaagagagagagaaagagaaggactactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggcc

SEQ ID NO: 110487 - DNA, 580 bp, Homo sapiens
  Payload ID: 1673
  Gene Symbol: ATG4B
  Gene Name: autophagy related 4B, cysteine peptidase
  ENST ID: ENST00000428861
  CDS Start-End: 1-580
acttttgcacaggtctgcttggttagtgaaagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagctgcagcctt

SEQ ID NO: 110488 - DNA, 623 bp, Homo sapiens
  Payload ID: 1673
  Gene Symbol: ATG4B
  Gene Name: autophagy related 4B, cysteine peptidase
  ENST ID: ENST00000430617
  CDS Start-End: 308-623
ggagttgccgggggtcggtctttccgcaggagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggaggttgtcgggacatttcactctccagtaaatgtggcccttggcgttactgagtcctaagaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatca

SEQ ID NO: 110489 - DNA, 807 bp, Homo sapiens
  Payload ID: 1673
  Gene Symbol: ATG4B
  Gene Name: autophagy related 4B, cysteine peptidase
  ENST ID: ENST00000425239
  CDS Start-End: 9-807
ctgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagtaagtggctcagagtttccatggacaagaaagttgaaatcacgggcaacatacacacttcctcgcctgagtccccacgggagcctcggcgagtgttgtcagtcgccccatgccgtgcaggtgctccgtggggcctgtgcgccaagccagatgcacggtggcctcgctctcctatcccggcggtcataccaagagaggagagcccaggctgtctggaggccgcgacttggtatctcacgtcgtgttttgtgtcttggttac

SEQ ID NO: 110490 - DNA, 524 bp, Homo sapiens
  Payload ID: 1673
  Gene Symbol: ATG4B
  Gene Name: autophagy related 4B, cysteine peptidase
  ENST ID: ENST00000429899
  CDS Start-End: 84-524
gggccatctggccatgagcacttctctctctgtctgccacgacaggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagaccc

SEQ ID NO: 110491 - DNA, 370 bp, Homo sapiens
  Payload ID: 1673
  Gene Symbol: ATG4B
  Gene Name: autophagy related 4B, cysteine peptidase
  ENST ID: ENST00000625810
  CDS Start-End: 104-370
gcgccggcacacctattggcccccgcggcgtcccgtcgccgcgtcgcgttgctggcccgtcggagcgacgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattgccattcatcattgttgtataccctggagctggaaggagatggggactggttctcagccttgcctctcaccggcggagaactga

SEQ ID NO: 110492 - DNA, 2938 bp, Homo sapiens
  Payload ID: 1674
  Gene Symbol: ATG4C
  Gene Name: autophagy related 4C, cysteine peptidase
  Uniprot ID: Q96DT6
  ENST ID: ENST00000317868
  CDS Start-End: 208-1584
gtacctgtagctgcggcgctgaggtcggaacgtctgcgtgtgtgcgggctggttttgtggcggctgctgctagagctggagcatttgccgggttggtggctcctgcacatttttacagttctccagtccttctctttcgtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 110493 - DNA, 665 bp, Homo sapiens
  Payload ID: 1674
  Gene Symbol: ATG4C
  Gene Name: autophagy related 4C, cysteine peptidase
  ENST ID: ENST00000371118
  CDS Start-End: 97-665
cccagagggagtggaaaggctttgaaagtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatga

SEQ ID NO: 110494 - DNA, 2890 bp, Homo sapiens
  Payload ID: 1674
  Gene Symbol: ATG4C
  Gene Name: autophagy related 4C, cysteine peptidase
  Uniprot ID: Q96DT6
  ENST ID: ENST00000371120
  CDS Start-End: 160-1536
gtacctgtagctgcggcgctgaggtcggaacgtctgcgtgtgtgcgggctggttttgtggcggctgctgctagagctggagcatttgccggtcagtataaaagattaaactctacagaagaatgcaatcaagtgatggcttttcctttagaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttcccacactgtcaaaaaatttactgcatcatttgaagcatcactttcaggggaaagagaattcaaaaccccaacaatttctctgaaggaaacaattgggaaatattctgatgatcatgaaatgcgaaatgaagtttatcataggaaaatcatctcttggtttggtgattcccccttggctctttttggcttacatcaactaatagaatatggaaagaagtctgggaaaaaagcaggagattggtatggaccagctgtggttgctcacattttaagaaaagcagttgaagaagcaaggcatcctgatttacaaggaataactatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgagacattccactgcccttctcccaaaaagatgtcttttcgaaaaatggatcccagctgtacaataggattttactgtcgaaatgttcaggacttcaaacgagcttctgaagaaatcaccaagatgctgaaattttcttctaaggagaaatatcccttatttacttttgtaaatggtcattccagagactatgattttacatctactacaaccaatgaagaagaccttttttcagaggatgaaaagaaacaattaaaaagatttagcacggaagagtttgtcttgctttaaagattagcacatttgtgcttgataagaagaattccattgaaaggggaaaaatgaagagaaacaagtatatctgaaatgtttattttcacaaatatcttaattttatatgttctttaaaaaagaacatttgaaaatataacagttaaagatatttttctaaaagagaaatgatttaatgaatcttgctttctaataaataaattgagtgattctggttgcattcctatttccctaagatctactagtgataattctaccttaactgtaagccttttagtcttcaaagtcttccacctgagcccattgttctcatggaggttttgtgatattaaccctcccccaaagactgggatcaccaaatagtttcaaaattctcagtttgtactgaagaccagaagatcagagaaggaaactttaatgctgtctagcctcctgctattaatgcaatcaaagaatacttttgcatatgtcttgataattaaatagtatttgttaactgtgatatgcatacacttatataagcagaattatgagttaaagtaatacttagcaatatgattttataatggctcctcattatgcttgctgttgaaccttttatgaggagtgaatataaagtattggttttccctcacaaatttaaagattatgttattaatactattataactgcatcaatcaagtcagataaaggcaactataaaatagtagtagtgtttgtttcctatctcaagggcgaaattttatgggaactcaatttattatgcagtttttaagtttaaaataccaagaaagatgtcactagattctcttctatgtgatttttgttttttatataaagcagtgtagtggtgtttagaagctgaggccacctgtaaggcaaatctgccttaagtgtattatgtgttacttaaaggcaaatttgtgatctaaaagtacaagagtgatttttgagctaggattataaaatacataataaagatgtgagaagataaaatgcttttgttttggttttaatgttgggattattttaatcctttcatttgaaaaatcagtgtctcaaatgaattctgttcatttataataaatgcatatattgctctgaaaacaatattaatttttttaagtggagctttcatgtttcagtgtagaaacgtgacttataaagacataaaattgtgtatcatctaaagtcattgatctcttccatcagaaaacctgtttgtttagagttgcatgtaaagctgaaagagagggtgggcggattgttttagtatacctgatgagaaaaatcaggtttgacatttctcagtgaagattacttactgagttgaaataaatagtctgaaatcta

SEQ ID NO: 110495 - DNA, 464 bp, Homo sapiens
  Payload ID: 1674
  Gene Symbol: ATG4C
  Gene Name: autophagy related 4C, cysteine peptidase
  ENST ID: ENST00000414558
  CDS Start-End: 1-332
ctatttatgttgcacaagattgtacagtttacaattctgatgtaattgataaacagagtgcttccatgacttctgataatgcagatgacaaagctgttattattctagttcctgttagacttggtggagaaagaaccaacaccgactacttagaatttgtgaagggtattttaagcctggaatattgtgtgggtattattggtggcaaacctaaacagtcatattactttgctggatttcaagatgacagtttgatttacatggatcctcattactgccaatcttttgtagatgtcagcataaaggatttccctcttgaggtcattttgtgatccagtattttaattcagaaaaatttgagaatacataaatgaaacatgtaattattacatggttttgattgttttcccagttggtgcttttacagactaaagtaattttacagaataaaataacttaaatca

SEQ ID NO: 110496 - DNA, 603 bp, Homo sapiens
  Payload ID: 1674
  Gene Symbol: ATG4C
  Gene Name: autophagy related 4C, cysteine peptidase
  ENST ID: ENST00000443289
  CDS Start-End: 149-603
gtacctgtagctgcggcgctgaggtcggaacgtctgcgtgtgtgcgggctggttttgtggcggctgctgctagagctggagcatttgccgggttggtggctcctgcacatttttacagttctccagtccttctctttcgaatttgaatatggaggctacaggaacagatgaagttgacaagctaaaaaccaaatttatatctgcttggaacaacatgaaatatagttgggtgttgaaaacaaagacgtattttagtagaaattctcctgtattattgcttggaaaatgttaccattttaaatatgaagatgaagataaaacgttacctgcagagtcgggatgtacaatagaggatcacgtaattgcaggaaatgtagaagaatttcgtaaagatttcatttctagaatatggctgacctacagggaagaattccctcaaatagaaggctcagctttgacaacagactgtgggtggggctgcacattgagaactggccagatgctcttggctcaaggactcatactacactttcttggtagagcttggacctggcctgatgctttgaatattgaaaattcagactctgaatcatggacttccca

SEQ ID NO: 110497 - DNA, 1949 bp, Homo sapiens
  Payload ID: 1675
  Gene Symbol: ATG4D
  Gene Name: autophagy related 4D, cysteine peptidase
  Uniprot ID: Q86TL0
  ENST ID: ENST00000309469
  CDS Start-End: 174-1598
agatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttga

SEQ ID NO: 110498 - DNA, 529 bp, Homo sapiens
  Payload ID: 1675
  Gene Symbol: ATG4D
  Gene Name: autophagy related 4D, cysteine peptidase
  ENST ID: ENST00000586863
  CDS Start-End: 1-529
gaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaaggtaggcccaccccctcctcactcctcccaccccccaccgcaccc

SEQ ID NO: 110499 - DNA, 729 bp, Homo sapiens
  Payload ID: 1675
  Gene Symbol: ATG4D
  Gene Name: autophagy related 4D, cysteine peptidase
  ENST ID: ENST00000585752
  CDS Start-End: 174-536
agatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagg

SEQ ID NO: 110500 - DNA, 931 bp, Homo sapiens
  Payload ID: 1675
  Gene Symbol: ATG4D
  Gene Name: autophagy related 4D, cysteine peptidase
  ENST ID: ENST00000589753
  CDS Start-End: 1-204
cgccgggacttcccgccccttcctgggggctgcctgacctcggactgtggctgggggtgcatgttacgcagcggccagatgatgctggcacagggccttctgctgcatttcctgcccagaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttga

SEQ ID NO: 110501 - DNA, 632 bp, Homo sapiens
  Payload ID: 1675
  Gene Symbol: ATG4D
  Gene Name: autophagy related 4D, cysteine peptidase
  ENST ID: ENST00000588972
  CDS Start-End: 1-534
gtgaaggaactcctgcgttgcgagctgtgcctgggcatcatgggtgggaaaccgcgacactcactgtacttcattggctaccaaggtaggcccaccccctcctcactcctcccaccccccaccgcacccccactcacacctgcaccccctgcagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttc

SEQ ID NO: 110502 - DNA, 628 bp, Homo sapiens
  Payload ID: 1675
  Gene Symbol: ATG4D
  Gene Name: autophagy related 4D, cysteine peptidase
  ENST ID: ENST00000586477
  CDS Start-End: 1-628
ttcaaggccaagttcctgacagcctggaacaacgtcaagtacggttgggtggttaaaagccggaccagctttagcaagatctccagcatccacctctgtggccgccgctaccgtttcgagggcgagggtgagctggtggttgggaccagggctgggggaggcctctccacgcccgccggagtgtccctggtggcagctgacagacccgctcttgtaggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcag

SEQ ID NO: 110503 - DNA, 1619 bp, Homo sapiens
  Payload ID: 1675
  Gene Symbol: ATG4D
  Gene Name: autophagy related 4D, cysteine peptidase
  ENST ID: ENST00000588667
  CDS Start-End: 121-807
ctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctctggcagtgatgatggtacttcctgttgtcagcccctcaagcccagctgcaaccagtctggggccattcagccagggacagagcccacagagcccatacacctgtctcccaccagcggggccctcctggcagggtagggaaggaggaccccgggcacccccctcagggcctgactcacgtactgtagtttgcactggacgcccgggccctccctgtcccaaagcccccttgggggaactgtggctgctgggggccaataaagctgtgtaacttga

SEQ ID NO: 110504 - DNA, 377 bp, Homo sapiens
  Payload ID: 1675
  Gene Symbol: ATG4D
  Gene Name: autophagy related 4D, cysteine peptidase
  ENST ID: ENST00000585437
  CDS Start-End: 1-300
gggaaaccgcgacactcactgtacttcattggctaccaagatgacttcctgctgtacctggaccctcactactgccagcccactgtggatgtcagccaggccgacttccccctggaggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtcgggtgtgggatcttgagctc

SEQ ID NO: 110505 - DNA, 1752 bp, Homo sapiens
  Payload ID: 1675
  Gene Symbol: ATG4D
  Gene Name: autophagy related 4D, cysteine peptidase
  ENST ID: ENST00000586417
  CDS Start-End: 197-679
tcatccggggtcctggcccgctaagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacgatgggggaatggaagcgctgttgctgtcatgcaagtgcttcatctcgctgggcgctgcccctacgtctccccaggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggtatgggccatcgctagtggcacacatcctcaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataaagggaggggatgaggggaaagatacaacactatttatttttttatttatgtcatgtc

SEQ ID NO: 110506 - DNA, 1555 bp, Homo sapiens
  Payload ID: 1675
  Gene Symbol: ATG4D
  Gene Name: autophagy related 4D, cysteine peptidase
  ENST ID: ENST00000588857
  CDS Start-End: 175-1179
aagatggcgatggctgcggtagcagcggcggcggctgttgcctggcccggtaccctggggacgggggccgagtagcgccttccccgggccccgtgaaccggctgcgggtcgcccttggggggcagcggccgcagccccccacctgggccctcggtccgccctcccggcgcgtccatgaactcagtgtcgccggccgccgcgcagtaccggagcagcagcccggaggacgcgcgccgccggcccgaggcccgcaggccgcggggtcccagaggcccagaccccaacggcctggggccttccggagccagcggccccgctcttggctctcccggggctggcccgagtgagccggacgaagtggacaagttcaaggccaagttcctgacagcctggaacaacgtcaagtacggttgggtggttaaaagccggaccagctttagcaagatctccagcatccacctctgtggccgccgctaccgtttcgagggcgagggtgacatacagcgtttccagcgggactttgtgtcccgcctgtggctcacataccgccgggacttcccgccccttcctgggggctgcctgacctcggactgtggctgggggtgcatgttacgcagcggccagatgatgctggcacagggccttctgctgcatttcctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggagtccttccactgcacctcgccccgcaagatggcctttgccaagatggacccaagctgtaccgtgggcttctatgctggagacaggaaggagtttgagacactctgctcagagctgaccagggtcctcagctcctcctcagccacagagcggtaccccatgttcaccctggccgagggccatgctcaggaccacagcctggacgacctctgctcccagctcgcccagcccacactccggctccctcgcacagggcggctcctcagggccaaacgccccagctctgaggactttgtgtttttataa

SEQ ID NO: 110507 - DNA, 607 bp, Homo sapiens
  Payload ID: 1675
  Gene Symbol: ATG4D
  Gene Name: autophagy related 4D, cysteine peptidase
  ENST ID: ENST00000587256
  CDS Start-End: 1-607
cctgcccagagactggacatgggccgagggcatgggcctgggcccccctgagctgtcagggtcagcctctcccagccggtaccatgggcctgcccgctggatgcccccacgctgggcccagggtgcccctgagctggagcaggaacgccggcaccggcagattgtgtcctggttcgccgaccacccccgggccccctttggcctacaccggctggtggagcttgggcagagctcaggcaagaaggcaggtgactggaaagccgtggagagctgctccgacgtcacccgcctggtggtgtacgtttctcaggactgcacagtgtacaaggcggatgtggcacgcctggtggccaggccagaccccacagccgagtggaagtctgtggtcatcctggtgcccgtgcgactgggtggcgagactctcaaccccgtgtatgtgccctgcgtgaaggaactcctgcgttgcgagctgtgcctgggcatcatgggtgggaaaccgcgacactcactgtacttcattggctaccaagatgacttcctgctgtacctggaccctcactactgccagcccactgtggatgtcagccaggccgacttccccctggag

SEQ ID NO: 110508 - DNA, 3092 bp, Homo sapiens
  Payload ID: 1676
  Gene Symbol: ATG5
  Gene Name: autophagy related 5
  Uniprot ID: Q9H1Y0
  ENST ID: ENST00000343245
  CDS Start-End: 201-1028
gcccgcccggccgcgatggcgggtgaaggtggttcctccgggcaaggtggagttggcgagacgccggcccggagccctggggccggttggcgggtgtggcctgcggggtccctcttggggtacatgtctgttgcttactaagtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaa

SEQ ID NO: 110509 - DNA, 2868 bp, Homo sapiens
  Payload ID: 1676
  Gene Symbol: ATG5
  Gene Name: autophagy related 5
  ENST ID: ENST00000360666
  CDS Start-End: 354-629
gtgacgtcatctccgggcgccgagggtgactggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaatt

SEQ ID NO: 110510 - DNA, 3088 bp, Homo sapiens
  Payload ID: 1676
  Gene Symbol: ATG5
  Gene Name: autophagy related 5
  Uniprot ID: Q9H1Y0
  ENST ID: ENST00000369070
  CDS Start-End: 431-1024
ctggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatgcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaa

SEQ ID NO: 110511 - DNA, 3216 bp, Homo sapiens
  Payload ID: 1676
  Gene Symbol: ATG5
  Gene Name: autophagy related 5
  Uniprot ID: Q9H1Y0
  ENST ID: ENST00000369076
  CDS Start-End: 325-1152
ctggacttgtggtgcgctgccagggctccgcagcgttgccggttgtattcgctggataccagagggcggaagtgcagcagggttcagctccgacctccgcgccggtgctttttgcggctgcgcgggcttcctggagtcctgctaccgcgtccccgcaggacagtgtgtcaggcgggcagcttgccccgccgccccaccggagcgcggaatctgggcgtccccaccagtgcggggagccggaaggaggagccatagcttggagtaggtttggctttggttgaaataagaatttagcctgtatgtactgctttaactcctggaagaatgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacagatttgaccagttttgggccatcaatcggaaactcatggaatatcctgcagaagaaaatggatttcgttatatcccctttagaatatatcagacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttcatctttgttgttttatcactgtaagcctgtcaaatcatagtatcctaagcatctgtaaatgctaattttgcatttttggaaaaacccattccttccaagctagtgtttttcattggctccaggtctaatttttcactgtggtccctggcagccagtcttttgaagtttaaagattacctgtctcttgactgcagtaccttttctttaatttttaccaaaaatatccagaggttactggagttcttattcaatataaggaaagtttgctgcactttattaccaagcctctgggattttaccagtcaaacatatttgtgcattacatttcatttcttgtgagctagctggctgtccatattgaatgttgacccatttgagtacgctaaaaggcttacagtatcagacacgatcatggttttagatcccataataaaaatgaatgtttttcttataaaaaattatacaaatgctgaagtgagattctactattgttcattgcttccttttctttttccttttgcgattttcactgattaatagcacatttcttcacaaaattagataaagttggtcaaagaccagatattctggaatggaaattgtaaagcttaatcaaaaagaatagccagtacagcatacaatctcagaaacttagaagcaagtagaaaataattggttgatgtaaacgaaagtgccattttagtaaaggcaggaaaaaaatagcaatatttgagttatgtaaggataaaaaatccactgacttgtatttttgcacaagaggctggtctgaatatgattgttcacattaagagtgtttattcgtcggttcattttggggattttcccccttgatgttttgacagattgaagtgagctttagtgagcaaaaggatcagaatgcagggaacactaagctgtgatgaagaaagtgtggtaaaaagccagagtagttttatacagacaaaaccagtgtcaggcctttgcagtaggcttgagtgaacttctgatctagatttgaaagtaaattttatgaagacattgcccatttttacttcctcattcattattgtaccagcatcatagctttattactctaatcccaggtaagtcaagcctacaatgccctagaggaagagtaaaaccagaaattcatgctggcttaaataatctatttttgtttcttttcatttgaatatttaaattttatggtttattaaaaaattaaataaa

SEQ ID NO: 110512 - DNA, 733 bp, Homo sapiens
  Payload ID: 1676
  Gene Symbol: ATG5
  Gene Name: autophagy related 5
  ENST ID: ENST00000613993
  CDS Start-End: 1-489
atgacagatgacaaagatgtgcttcgagatgtgtggtttggacgaattccaacttgtttcacgctatatcaggatgagataactgaaagggaagcagaaccatactatttgcttttgccaagagtaagttatttgacgttggtaactgacaaagtgaaaaagcactttcagaaggttatgagacaagaagacattagtgagatatggtttgaatatgaaggcacaccactgaaatggcattatccaattggtttgctatttgatcttcttgcatcaagttcagctcttccttggaacatcacagtacattttaagagttttccagaaaaagaccttctgcactgtccatctaaggatgcaattgaagctcattttatgtcatgtatgaaagaagctgatgctttaaaacataaaagtcaagtaatcaatgaaatgcagaaaaaagatcacaagcaactctggatgggattgcaaaatgacaacgactgaaagacctttcattcagaagctgtttcgtcctgtggctgcagatggacagttgcacacactaggagatctcctcaaagaagtttgtccttctgctattgatcctgaagatggggaaaaaaagaatcaagtgatgattcatggaattgagccaatgttggaaacacctctgcagtggctgagtgaacatctgagctacccggataattttcttcatattagtatcatcccacagccaacagattga

SEQ ID NO: 110513 - DNA, 4959 bp, Homo sapiens
  Payload ID: 1677
  Gene Symbol: ATG7
  Gene Name: autophagy related 7
  Uniprot ID: O95352
  ENST ID: ENST00000354449
  CDS Start-End: 26-2137
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctgggacttggtcctccatgcagtttttatttcttgtcacagtgactgatagccatcccccaggatcctttccccttggccctgagggggtgacccaacacagaccaaatggggaaatgagcaaccagctcctgcccagagccactgcgggaggtggcaccctcatccccggaatgtgctgcccaccgcaccgcaggctcctcctgtgggggccctgggcatgggtgagggtgggaccccgtgagcgcactgcaccctggccctggtggagcgggaggaggaggagagccgagctgggtacgagactaaagggcccacatgacccagtgacgccagatttccaccaaggactgagtgagctgctcagacatggctttctgcctcccagcctgtcctccactgtgggcatagcatctgtgcctgcctgcctgcttgagggagaggagtttctgctgctgccttgagctggggggaagagcccaggggcagatcctggcagctgcctggatggggctcctccctgcccttatgagcaggccaggcccagaaaggccgagcctgggctgccttcctgccccagccgagggaggggtcagacggctctaccatgggtaactcaggcaagagctggttttcctctttattctgggtgtgtgcagctgtgaggccccaacccaggagaggccatggcctaggtacctgtgaccaccctgcccccgtgtagagggcatcgtctttcctgctattttattctttcagcttttgtcttaggcccagaatcaaagtgaaaattgagtcgagctgacccttacaacagtaggatttagtagggtagatttcaaatgaggcttcgcttctcccaaagtagccagtccaagttccagtggctgtcgttcagctcatgggagcttcatggggacacagccggcacaggtgcagggcccgagtccgcccacccagcctggcgctgaaactgcacacgtacactatgtggtttaagagcactttattattgttcttaaggctacttttaagtacaaaaaaagatggcctgccaaacctttttttttcttcttccaggaaaaacaggccacagagaatggtatattacagatttacacacatgaagagaaggtcagagcgcactgcaggcagcgcggctctgggaagaacttcacggagccccttcttagagcagggagggggctttctcagtgaaatgtttggttttctgctgcctcctctgccccaggcccccctccagggtactgcctatcccagataggtcagtgcaccagggacccggccgccagcaccgccgacccctcccagagtgacgcccttgttcactgacaaagagacctgtcccaggagtgtcctccaccgagccggtcagctgtgggtggttttcctgttacgacgctcagtagcctgtagcaataacaaactcgtggctatgaatgcagatgcagtgttctcatagaataactgttcctgcacttttacagacaaatctacgacaaaaaaaaagatcaactttttttttccgaacaacaaaaaaaatgaatgattacaataggaaagggaaaaattaaatagctacatatcattaacaaattaatgttcttcaaaaaatacctacaaatttctctgtacattctttacgcacagcgtaacgatggtctcaaaatcacccatatagaaaagtgttctcaacgatttttcctacagaaaatataggggcctgaatgccaaagcttggaagcccagtacagtgggagtgaaatgtgtgcggggcaaggagaagggcttttctttcctccacttttcaaaggcctgcagccactctgtgactacaagagccagtcctccgaccttttcacccagtgccaatttccaaaattcaacagctaaaaactgtaaaaccgggggtcatacggtgtgcagagtccacaaagccttgcaggtgaggtgaccacgcccacgtcacctggtcaggtgccatcgtcgtgagcctctggtgggccaggtgggacacagcacaccccagggggaggggatagaaacgctcattgaccaaaaaggagcagctgtgacctccacagctgtgtctgtcatgcttgcttcatctaatttctagttagtagctattaatatagcaaataataaatgcagtaataacagtataaagtcagaggaatgtatactgccttggccccagcgtacgaggaagcgtataaaacaccatatcacagattgtctgtcagtaatctgctgttcagccaagagagttcaaagggagcagtttctgcatgtagggaagttggaagacacaaaccccacctcccctgggagcttgtaacaaagcagacagggatgcaaaaataaatgatgtcagcctgcagccaaactccagcatcccacaccgcagctgacccactgctcatcgcgagggcctgccaggagctggcctcccgcactacttgtgagtaaagtgaatatcaaataccaatcttagagtacaactgtaccagcagtaagtatatctaggactgtaactgacaaaaataaactaattctgaaaagaa

SEQ ID NO: 110514 - DNA, 2296 bp, Homo sapiens
  Payload ID: 1677
  Gene Symbol: ATG7
  Gene Name: autophagy related 7
  Uniprot ID: O95352
  ENST ID: ENST00000354956
  CDS Start-End: 26-2056
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccaggttcttgatcaatatgaacgagaaggatttaacttcctagccaaggtgtttaattcttcacattccttcttagaagacttgactggtcttacattgctgcatcaagaaacccaagctgctgagatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgcccaggagtggccagtgttcggcgttgctcgggattcaagataccaccagttcagagctaaataataaccttggccttggccttgctattgacctggga

SEQ ID NO: 110515 - DNA, 455 bp, Homo sapiens
  Payload ID: 1677
  Gene Symbol: ATG7
  Gene Name: autophagy related 7
  ENST ID: ENST00000427759
  CDS Start-End: 1-290
ggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagcatctttgagatcttcggctctggatgaagcaggagaggcagaacataaacaaatggacggaagaatcaagcacttctgtgaatggaatcttttattcctcgcccatctgattcttggctgctttgttccataaggtagatgaacaatgatgataaaataaaatgtaaataaga

SEQ ID NO: 110516 - DNA, 584 bp, Homo sapiens
  Payload ID: 1677
  Gene Symbol: ATG7
  Gene Name: autophagy related 7
  ENST ID: ENST00000418682
  CDS Start-End: 36-266
tgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtc

SEQ ID NO: 110517 - DNA, 565 bp, Homo sapiens
  Payload ID: 1677
  Gene Symbol: ATG7
  Gene Name: autophagy related 7
  ENST ID: ENST00000444619
  CDS Start-End: 285-565
agctgtggttgccggaagttgagcggcggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcga

SEQ ID NO: 110518 - DNA, 647 bp, Homo sapiens
  Payload ID: 1677
  Gene Symbol: ATG7
  Gene Name: autophagy related 7
  ENST ID: ENST00000435760
  CDS Start-End: 449-647
agtggcaagcgcgggcaggaccgcgttgcgtcatcggggcgcgcgcctcagagagagctgtggttgccggaagttgagcggcggatccaattcctgtatcttcaccttgtctaccgggatttctagagcagccttgtgagagacatttctgagacctgtatgtcctgcgtctatgattcttccctgatcaaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagt

SEQ ID NO: 110519 - DNA, 553 bp, Homo sapiens
  Payload ID: 1677
  Gene Symbol: ATG7
  Gene Name: autophagy related 7
  ENST ID: ENST00000434066
  CDS Start-End: 1-318
cctgccctctgtcttccagagagtttacctctcattcaggggccagtgggtttggatcaaaggttttcactaaaacagattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatgattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatg

SEQ ID NO: 110520 - DNA, 435 bp, Homo sapiens
  Payload ID: 1677
  Gene Symbol: ATG7
  Gene Name: autophagy related 7
  ENST ID: ENST00000446110
  CDS Start-End: 1-418
gggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgaggatcatctttctttcatccggcccaagaatggcaccttccccgcccatcaggccacctgcactcaggagtcggctgcctgtcctgaaatagatctctaccagctctcaagcagaacaattccttgcattcatacttgaatgtataatttgtgtta

SEQ ID NO: 110521 - DNA, 710 bp, Homo sapiens
  Payload ID: 1677
  Gene Symbol: ATG7
  Gene Name: autophagy related 7
  ENST ID: ENST00000414717
  CDS Start-End: 1-288
aggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaagttcttgatcaatatgaacgagaaggatttaacttcctagccaaggtgtttaattcttcacattccttcttagaagacttgactggtcttacattgctgcatcaagaaacccaagctgctgagcactaagaagattttcttacattgatacctactgtgacaaaacacacatccaatgacagtgttaaaatgtcataaatgagcctttaaaagaatgaggcacatgatacatcatggtacttgagcagactgcaagcctgaccagactgaattcatgaattcctgacttttgacttcttcctgtaagatgctaccccactgccagggactcaacctctaaatccagtcaaggggctacttgggcctggaaccaaggcacagtcaaggtgaaccagctatgctccagggggaggtggttgaaatcactggtctcctggactgggccatgagtgatggttattggggctggggaggtatgagagacatcgtgttgtccatctacctctgtgtatcttcaaaggtctctgtaataaaaagttttctgaaattta

SEQ ID NO: 110522 - DNA, 565 bp, Homo sapiens
  Payload ID: 1677
  Gene Symbol: ATG7
  Gene Name: autophagy related 7
  ENST ID: ENST00000419112
  CDS Start-End: 298-565
gagcggcggtaagtgagccgcggcgggcgagggtgtagtggggtcttgctgggccggttttggaggcctggagtcaaggggcgagctcgccagggagggcgagggtcacagcaagtctcaggatcctcctctgccagtttctgggtggtccttcctcctccagggactcactgattccggctggcgcccttcgtctgtagccgcgtcccctcagactggttcagtccggggtcttctgacttggaagctcgtgctgatttcctaagtcagcccctcctgtcctcttggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataaca

SEQ ID NO: 110523 - DNA, 758 bp, Homo sapiens
  Payload ID: 1677
  Gene Symbol: ATG7
  Gene Name: autophagy related 7
  ENST ID: ENST00000424071
  CDS Start-End: 1-233
ctgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaa

SEQ ID NO: 110524 - DNA, 549 bp, Homo sapiens
  Payload ID: 1677
  Gene Symbol: ATG7
  Gene Name: autophagy related 7
  ENST ID: ENST00000451830
  CDS Start-End: 94-549
agtggcaagcgcgggcaggaccgcgttgcgtcatcggggcgcgcgcctcagagagagctgtggttgccggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcaattgaagcactagagtgtgcatatgataatctttgtcaaacagaa

SEQ ID NO: 110525 - DNA, 2042 bp, Homo sapiens
  Payload ID: 1677
  Gene Symbol: ATG7
  Gene Name: autophagy related 7
  Uniprot ID: O95352
  ENST ID: ENST00000446450
  CDS Start-End: 26-1897
ggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcaattgaagcactagagtgtgcatatgataatctttgtcaaacagaaggagtcacagctcttccttacttcttaatcaagtatgatgagaacatggtgctggtttccttgcttaaacactacagtgatttcttccaaggtcaaaggacgaagataacaattggtgtatatgatccctgtaacttagcccagtaccctggatggcctttgaggaattttttggtcctagcagcccacagatggagtagcagtttccagtctgttgaagttgtttgcttccgtgaccgtaccatgcagggggcgagagacgttgcccacagcatcatcttcgaagtgaagcttccagaaatggcatttagcccagattgtcctaaagcagttggatgggaaaagaaccagaaaggaggcatgggaccaaggatggtgaacctcagtgaatgtatggaccctaaaaggttagctgagtcatcagtggatctaaatctcaaactgatgtgttggagattggttcctactttagacttggacaaggttgtgtctgtcaaatgtctgctgcttggagccggcaccttgggttgcaatgtagctaggacgttgatgggttggggcgtgagacacatcacatttgtggacaatgccaagatctcctactccaatcctgtgaggcagcctctctatgagtttgaagattgcctagggggtggtaagcccaaggctctggcagcagcggaccggctccagaaaatattccccggtgtgaatgccagaggattcaacatgagcatacctatgcctgggcatccagtgaacttctccagtgtcactctggagcaagcccgcagagatgtggagcaactggagcagctcatcgaaagccatgatgtcgtcttcctattgatggacaccagggagagccggtggcttcctgccgtcattgctgcaagcaagagaaagctggtcatcaatgctgctttgggatttgacacatttgttgtcatgagacatggtctgaagaaaccaaagcagcaaggagctggggacttgtgtccaaaccaccctgtggcatctgctgacctcctgggctcatcgctttttgccaacatccctggttacaagcttggctgctacttctgcaatgatgtggtggccccaggagattcaaccagagaccggaccttggaccagcagtgcactgtgagtcgtccaggactggccgtgattgcaggagccctggccgtggaattgatggtatctgttttgcagcatccagaagggggctatgccattgccagcagcagtgacgatcggatgaatgagcctccaacctctcttgggcttgtgcctcaccagatccggggatttctttcacggtttgataatgtccttcccgtcagcctggcatttgacaaatgtacagcttgttcttccaaaatctgggacatgagcgatgatgagaccatctgagatggccccgctgtggggctgacttctccccggccgcctgctgaggagctctccatcgccagagcaggactgctgaccccaggcctggtgattctgggcccctcctccataccccgaggtctgggattcccccctctgctgccca

SEQ ID NO: 110526 - DNA, 972 bp, Homo sapiens
  Payload ID: 1677
  Gene Symbol: ATG7
  Gene Name: autophagy related 7
  ENST ID: ENST00000451513
  CDS Start-End: 445-972
ggcatgcctctgctcctttgcgcacgcgcgccgcttcccagtggcaagcgcgggcaggaccgcgttgcgtcatcggggcgcgcgcctcagagagagctgtggttgccggaagttgagcggcgagcagccttgtgagagacatttctgagacctgtatgtcctgcgtctatgattcttccctgatcaaggcttctcaaaccccataatgctggtatccagtgcatccgttctcaaaaactgaagctgatggacaccagattgcatgtgaaggtgaaggatattatagcagaaggaaaccaaaataaaagaaaaacagctcctggaagtaaccaatgagaaggacagataagagtttgaagactgtggatgtgactgcttgttccctggttgacacactgaagaagaaatcatgttgattcagagttggcttggaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgtactcctcaacaagttcctcctcttgacatttgcagatctaaagaagtaccacttctactattggttttgctatcctgccctctgtcttccagagagtttacctctcattcaggggccagtgggtttggatcaaaggttttcactaaaacag

SEQ ID NO: 110527 - DNA, 589 bp, Homo sapiens
  Payload ID: 1677
  Gene Symbol: ATG7
  Gene Name: autophagy related 7
  ENST ID: ENST00000423116
  CDS Start-End: 212-589
agtctggtcctcactgctgtggattgcctttactaaaatagagatctatgcagaaatacagttgcatagcttttcacataaggctcttcatgatatggcctttgcctgcttttatggcatggtccatctactctgccccatgtgcctctccttgctgccatacagaactctatcaggggaacctgcccccaatatttcaaggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggctgccagctcgcttaacattggagttcagtgcttttgacatgagtgctcccaccccagcccgttgctgcccagctattggaacactgtataacaccaacacactcgagtctttcaagactgcagataagaagctccttttggaacaagcagcaaatgagatatgggaatccataaaatcaggcactgctcttgaaaaccctgta

SEQ ID NO: 110528 - DNA, 3130 bp, Homo sapiens
  Payload ID: 1678
  Gene Symbol: ATG9A
  Gene Name: autophagy related 9A
  Uniprot ID: Q7Z3C6
  ENST ID: ENST00000361242
  CDS Start-End: 218-2737
gtgcttattggccagcctggctgcgggtgacagtgagtggcagacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctg

SEQ ID NO: 110529 - DNA, 3799 bp, Homo sapiens
  Payload ID: 1678
  Gene Symbol: ATG9A
  Gene Name: autophagy related 9A
  Uniprot ID: Q7Z3C6
  ENST ID: ENST00000396761
  CDS Start-End: 213-2732
agtcccgtccctgaagccgagaattggccgttgtgtctccgccccccgtgcttattggccagcctggctgcgggtgacagtgagtggcagacacccggcctagcgccgcgggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 110530 - DNA, 3701 bp, Homo sapiens
  Payload ID: 1678
  Gene Symbol: ATG9A
  Gene Name: autophagy related 9A
  Uniprot ID: Q7Z3C6
  ENST ID: ENST00000409033
  CDS Start-End: 174-1760
cacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccaga

SEQ ID NO: 110531 - DNA, 2512 bp, Homo sapiens
  Payload ID: 1678
  Gene Symbol: ATG9A
  Gene Name: autophagy related 9A
  Uniprot ID: Q7Z3C6
  ENST ID: ENST00000409422
  CDS Start-End: 176-2512
agacacccggcctagcgccgcgggtcgcgccgagccgagccgagccgagcggagccggcggagcctctggaatcacccgggtcgctgttcctgagcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatag

SEQ ID NO: 110532 - DNA, 4025 bp, Homo sapiens
  Payload ID: 1678
  Gene Symbol: ATG9A
  Gene Name: autophagy related 9A
  Uniprot ID: Q7Z3C6
  ENST ID: ENST00000409618
  CDS Start-End: 441-2960
ggggcgcgcgcgggcgccggggccgcgcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctctgcgcttccgcctgcctggcctcggggaagctgtcttcttcacccgtggtctcaagtacaactttgagctgatcctcttctggggacctggctctctgtttctcaatgaatggagcctcaaggccgagtacaaacgtggggggcaacggctagagctggcccagcgcctcagcaaccgcatcctgtggattggcatcgctaacttcctgctgtgccccctcatcctcatatggcaaatcctctatgccttcttcagctatgctgaggtgctgaagcgggagccgggggccctgggagcacgctgctggtcactctatggccgctgctacctccgccacttcaacgagctggagcacgagctgcagtcccgcctcaaccgtggctacaagcccgcctccaagtacatgaattgcttcttgtcacctcttttgacactgctggccaagaatggagccttcttcgctggctccatcctggctgtgcttattgccctcaccatttatgacgaagatgtgttggctgtggaacatgtgctgaccaccgtcacactcctgggggtcaccgtgaccgtgtgcaggtcctttatcccggaccagcacatggtgttctgccctgagcagctgctccgcgtgatcctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgacca

SEQ ID NO: 110533 - DNA, 576 bp, Homo sapiens
  Payload ID: 1678
  Gene Symbol: ATG9A
  Gene Name: autophagy related 9A
  ENST ID: ENST00000456708
  CDS Start-End: 184-480
agtgagtggcagacacccggcctagcgccgcgggtcgcgccgagccgagccgagccgagcggagccggcggagcctctggaatcacccgggtcgctgttcctgagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgaacgtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggct

SEQ ID NO: 110534 - DNA, 574 bp, Homo sapiens
  Payload ID: 1678
  Gene Symbol: ATG9A
  Gene Name: autophagy related 9A
  ENST ID: ENST00000412355
  CDS Start-End: 132-428
gagtggcagacacccggcctagcgccgcgggtcgcgccgagccgagccgagccgagcggagccggcggagcctctggaatcacccgggtcgctgttcctgaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgaacgtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggctt

SEQ ID NO: 110535 - DNA, 568 bp, Homo sapiens
  Payload ID: 1678
  Gene Symbol: ATG9A
  Gene Name: autophagy related 9A
  ENST ID: ENST00000434939
  CDS Start-End: 290-568
cttgagaccctggagttggaagagtggcccggtttagcacagccagaggaagtgctcgtagtcctgggctggaagggtgcttcttccccactgcagccttcctgccccatgcttggcctcctcttggtggggtgtggatggctgggagggttgggttcctttttatccccactgcccactctctggggcctgacatcttctcctccagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctattt

SEQ ID NO: 110536 - DNA, 581 bp, Homo sapiens
  Payload ID: 1678
  Gene Symbol: ATG9A
  Gene Name: autophagy related 9A
  ENST ID: ENST00000431715
  CDS Start-End: 182-581
agtgagtggcagacacccggcctagcgccgcgggtcgcgccgagccgagccgagccgagcggagccggcggagcctctggaatcacccgggtcgctgttcctgaggcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgtgcagacgcagaaggagcaccagatctgcatccacaaacgtgagctgacagaactggacatctaccaccgcatcctccgtttccagaactacatggtggcactggttaacaaatccctcctgcctc

SEQ ID NO: 110537 - DNA, 5245 bp, Homo sapiens
  Payload ID: 1678
  Gene Symbol: ATG9A
  Gene Name: autophagy related 9A
  ENST ID: ENST00000446716
  CDS Start-End: 1-766
gcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggggtggatgccaggacagccagctccgggagcagcgtgtgggaaggacagctgcagagcctggtgctgtcagaatatgcatccacagagatgagcctgcatgccctctatatgcaccagctccacaagcagcaggcccaggctgaacctgagcggcatgtatggcaccgccgggagagtgatgagagtggagaaagcgcccctgatgaagggggagagggcgcccgggccccccagtctatccctcgctctgctagctatccctgtgcagcaccccggcctggagctcctgagaccactgccctgcatgggggcttccagaggcgctacggtggcatcacagatcctggcacagtgcccagggttccctctcatttctctcggctgcctcttggagggtgggcagaagatgggcagtcggcatcaaggcaccctgagcccgtgcccgaagagggctcggaggatgagctaccccctcaggtgcacaaggtatagacaaggctgagcagggttcctgtggcccaggatggaggccaccgctgccctgccatcccgtctgcctgccatgggacggctcctctgagtgttccctggccccacgtgtgtggtgtttgtgtgtctgtgcctggccaagggaggtgccaacactgggcttgccacagccccaggagaggaatttggggcctaggaaccgagggcacacgggactctagcctcatccccaggacccccttggctcagagtgtggtgctagaaactggcccccagcccagccccagtactgccacctttacacctacccctgcaagtccccagagggctgcccacgatagaagctgccaagcagggagaacctgtgccaactgtggagtggggaggttgggcctggaccctcaacccctgcaaccttccctagccccctcaatagatgagcaggtcaggctgtggcccttacctcacccgcagttctcgcccagtgctgcagccggctcacctctctccgcttcttgcacatcactggcctgtgtgtgctgcttgctcctgttctgttcgcttgctcccgttccgttcggcttttgctttgcgttagggtgaagaccctagcgtccagctcccctcaacgctatattttgacactaaaaaagaaggtttctaaattgtaggagcaggatggaaatactttgctgcccttgccatcttttaggatgggcccccaggagactgaggtcttcctgggccctcattgctgcttatcgtaccccccatcacctgcacatgggacagaccgggctggagggtgaccttggctgtgtgcgtcccagcaaaagagctctggcccgcatctcgctgtgccctgaagggggatgaagggcgatgcctcgcccgaggctttgggctgctgcactgcatgctgggactgctcctactctctgtcccacccctcacccagctgtggtccggctttgggagagtggtgaattgcgctgcccgaactcggagcggagcagggtagggaccgtgtacagcttgataacccttaataaaaagggagtttgaccagacttcttgttgtctcgcgcggctagaatcctgggaacaagagaaatgggatggggactctgccggggtctagaagaaagtatgtttaggccgtcgctcagatacgctgagcaaggcggctggcggaagggcagcttccgacccacagttccgtggaggtctgtgtcctgccccgagccaggattccgtgaggtctgtttccagccccgagccacgattccgtggaggtttccagctcggcctggtcgtcagatttcccgccctgggcacgtgaccaagccggctctgcttctctaatttgcattcgttgcctgcaccattccccccgctcccccctcggagacatttggccaatgggagccgtgggtaggggctgtgggcggggctacagccgtggagcgcggtgcgagtccaacaccgagcattcccgtgggcctgcagttggcaggagggtcccgggcccagagccagcggggccgtgctgagacggcgtacgtgccctgcgtgagtgcgtggcggcggcgcgtgcgctaggggagtgggcggtgaggcctggtccacgtgcgtcccttcccgggacccccgcagcttggcgcccagcggctacgtgagccaaggcacccggatgtccgcgcccctctccgagtgaccagtcccggcctccggtcccgcagtgcccgcagcctcggccggcgtccacgcattgccatggtgactgtgggcaactactgcgaggccgaagggcccgtgggtccggcctggatgcaggatggcctgagtccctgcttcttcttcacgctcgtgccctcgacgcggatggctctggggactctggccttggtgctggctcttccctgcagacgccgggagcggcccgctggtgctgattcgctgtcttggggggccggccctcgcatctctccctacgtgctgcagctgcttctggccacacttcaggcggcgctgcccctggccggcctggctggccgggtgggcactgcccggggggccccactgccaagctatctacttctggcctccgtgctggagagtctggccggcgcctgtggcctgtggctgcttgtcgtggagcggagccaggcacggcagcgtctggcaatgggcatctggatcaagttcaggcacagccctggtctcctgctcctctggactgtggcgtttgcagctgagaacttggccctggtgtcttggaacagcccacagtggtggtgggcaagggcagacttgggccagcaggttcagtttagcctgtgggtgctgcggtatgtggtctctggagggctgtttgtcctgggtctctgggcccctggacttcgtccccagtcctatacattgcaggttcatgaagaggaccaagatgtggaaaggagccaggttcggtcagcagcccaacagtctacctggcgagattttggcaggaagctccgcctcctgagtggctacctgtggcctcgagggagtccagctctgcagctggtggtgctcatctgcctggggctcatgggtttggaacgggcactcaatgtgttggtgcctatattctataggaacattggtgagcaggaggagcaccagctcagtgtgctggtccttcatcagcctggtggctgggatggtccttacctagggaggtgggacagagctgggtggtcagaaagagactgtggctggtacctggggccattttgcctgaagagagtcctgggcgccataagtgggttctgactcgtttcctccacagtgaacttgctgactgagaaggcaccttggaactctctggcctggactgttaccagttacgtcttcctcaagttcctccaggggggtggcactggcagtacaggcttcgtgagcaacctgcgcaccttcctgtggatccgggtgcagcagttcacgtctcggcgggtggagctgctcatcttctcccacctgcacgagctctcactgcgctggcacctggggcgccgcacaggggaggtgctgcggatcgcggatcggggcacatccagtgtcacagggctgctcagctacctggtgttcaatgtcatccccacgctggccgacatcatcattggcatcatctacttcagcatgttcttcaacgcctggtttggcctcattgtgttcctgtgcatgagtctttacctcaccctgaccattgtggtcactgagtggagaaccaagtttcgtcgtgctatgaacacacaggagaacgctacccgggcacgagcagtggactctctgctaaacttcgagacggtgaagtattacaacgccgagagttacgaagtggaacgctatcgagaggccatcatcaaatatcagggtttggagtggaagtcgagcgcttcactggttttactaaatcagacccagaacctggtgattgggctcgggctcctcgccggctccctgctttgcgcatactttgtcactgagcagaagctacaggttggggactatgtgctctttggcacctacattatccagctgtacatgcccctcaattggtttggcacctactacaggatgatccagaccaacttcattgacatggagaacatgtttgacttgctgaaagaggagacagaagtgaaggaccttcctggagcagggccccttcgctttcagaagggccgtattgagtttgagaacgtgcacttcagctatgccgatgggcgggagactctgcaggacgtgtctttcactgtgatgcctggacagacacttgccctggtgggcccatctggggcagggaagagcacaattttgcgcctgctgtttcgcttctacgacatcagctctggctgcatccgaatagatgggcaggacatttcacagggtacaggacacaggtgggcgagcggggactgaagctgagcggcggggagaagcagcgcgtcgccattgcccgcaccatcctcaaggctccgggcatcattctgctggatgaggcaacgtcagcgctggatacatctaatgagagggccatccaggcttctctggccaaagtctgtgccaaccgcaccaccatcgtagtggcacacaggctctcaactgtggtcaatgctgaccagatcctcgtcatcaaggatggctgcatcgtggagaggggacgacacgaggctctgttgtcccgaggtggggtgtatgctgacatgtggcagctgcagcagggacaggaagaaacctctgaagacactaagcctcagaccatggaacggtgacaaaagtttggccacttccctctcaaagactaacccagaagggaataagatgtgtctcctttccctggcttatttcatcctggtcttggggtatggtgctagctatggtaagggaaagggacctttccgaaaaacatcttttggggaaataaaaatgtggactgtg

SEQ ID NO: 110538 - DNA, 733 bp, Homo sapiens
  Payload ID: 1678
  Gene Symbol: ATG9A
  Gene Name: autophagy related 9A
  ENST ID: ENST00000429920
  CDS Start-End: 1-733
ctcgctcacatccactacatgcctgaccactggcagggtaatgcccaccgctcgcagacccgggacgagtttgcccagctcttccagtacaaggcagtgttcattttggaagagttgctgagccccattgtcacacccctcatcctcatcttctgcctgcgcccacgggccctggagattatagacttcttccgaaacttcaccgtggaggtcgttggtgtgggagatacctgctcctttgctcagatggatgttcgccagcatggtcatccccagtggctatctgctgggcagacagaggcctcagtgtaccagcaagctgaggatggaaagacagagttgtcactcatgcactttgccatcaccaaccctggctggcagccaccacgtgagagcacagccttcctaggcttcctcaaggagcaggttcagcgggatggagcagctgctagcctcgcccaagggggtctgctccctgaaaatgccctctttacgtctatccagtccttacaatctgagtctgagcccctgagccttatcgcaaatgtggtagctggctcatcctgccggggccctccactgcccagagacctgcagggctccaggcacagggctgaagtcgcctctgccctgcgctccttctccccgctgcaacccgggcaggcgcccacaggccgggctcacagcaccatgacaggctctggctccacaagcagcaggcccaggctgaacc

SEQ ID NO: 110539 - DNA, 893 bp, Homo sapiens
  Payload ID: 1678
  Gene Symbol: ATG9A
  Gene Name: autophagy related 9A
  ENST ID: ENST00000436856
  CDS Start-End: 331-893
ctagcgccgcgggtcgcgccgagccgagccgagccgagcggagccggcggagcctctggaatcacccgggtcgctgttcctgaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagcagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatgtctgcccttccgtattgcacgtggcaagaagtgcaggcccggatcgt

SEQ ID NO: 110540 - DNA, 699 bp, Homo sapiens
  Payload ID: 1678
  Gene Symbol: ATG9A
  Gene Name: autophagy related 9A
  ENST ID: ENST00000457841
  CDS Start-End: 184-699
agtgagtggcagacacccggcctagcgccgcgggtcgcgccgagccgagccgagccgagcggagccggcggagcctctggaatcacccgggtcgctgttcctgagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcatccctatg

SEQ ID NO: 110541 - DNA, 796 bp, Homo sapiens
  Payload ID: 1678
  Gene Symbol: ATG9A
  Gene Name: autophagy related 9A
  ENST ID: ENST00000432520
  CDS Start-End: 363-796
gcgcgaggttgtccgctgttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatcca

SEQ ID NO: 110542 - DNA, 700 bp, Homo sapiens
  Payload ID: 1678
  Gene Symbol: ATG9A
  Gene Name: autophagy related 9A
  ENST ID: ENST00000428226
  CDS Start-End: 192-700
ctagcgccgcgggtcgcgccgagccgagccgagccgagcggagccggcggagcctctggaatcacccgggtcgctgttcctgagcagctgcagagcatcgagggctggagaggagcacatactgtccatggagctgggtctcttcttcctccttattggcaggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcccttatcaccatcctggtcattgctggtgtcttctggatccaccggcttatcaagttcatctataacatttgctgctactgggagatccactccttctacctgcacgctctgcgcat

SEQ ID NO: 110543 - DNA, 589 bp, Homo sapiens
  Payload ID: 1678
  Gene Symbol: ATG9A
  Gene Name: autophagy related 9A
  ENST ID: ENST00000439812
  CDS Start-End: 197-589
agtgagtggcagacacccggcctagcgccgcgggtcgcgccgagccgagccgagccgagcggagccggcggagcctctggaatcacccgggtcgctgttcctgagcagctgcagagcatcgagggctggagaggagcacatactgtccatggagctggtagggccatgtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatggtgaaccacagtcttcaccctactgaacccgtcaaggtcactctgccagacgcctttttgcctgctcaagtctgtagtgccaggattcaggaaaatggctcc

SEQ ID NO: 110544 - DNA, 685 bp, Homo sapiens
  Payload ID: 1678
  Gene Symbol: ATG9A
  Gene Name: autophagy related 9A
  ENST ID: ENST00000443140
  CDS Start-End: 395-685
gttgggagctgccagcccttggcctggggccgggcgaccctggggcgaggtggactccggtccacggtcgccgcggctgggtgtggggaggcaagccaacccacccgggctatcagctgtaaggctgactcgatccctgcaacatccgcaggaacccctgagcccaggcccagccggccggggctccacgggccctggtccacactgaccctgtgagtggtgacttccctgaggggcagggctctcactagcccagggaatcccaccggggccaggctgggccaagatccacggcccccaggggctgcacggacagctgcagagcatcgagggctggagaggagcacatactgtccatggagctggtggtcaaggtggacagggggcggtggtgatggcgcagtttgacactgaataccagcgcctagaggcctcctatagtgattcacccccaggggaggaggacctgttggtgcacgtcgccgaggggagcaagtcaccttggcaccatattgaaaaccttgacctcttcttctctcgagtttataatctgcaccagaagaatggcttcacatgtatgctcatcggggagatctttgagctcatgcagttcctctttgtggttgccttcactaccttcctggtcagctgcgtggactatgacatcctatttgccaacaagatg

SEQ ID NO: 110545 - DNA, 4572 bp, Homo sapiens
  Payload ID: 1679
  Gene Symbol: ATG9B
  Gene Name: autophagy related 9B
  Uniprot ID: Q674R7
  ENST ID: ENST00000605952
  CDS Start-End: 77-2851
agctcagtgtcacagacctttgtggaagcaacaacagctcccatccttccaacctttctggagaagccgtggcctgatggtgagccgaatgggctggggggggagaagaaggcggctggggcggtggggagatctggggcccggatcggtgcccctcctccccatgccactgccacctcctcctcctccttcatgccggggacctgggggagggaggatctccatcttctctctgtcccctgcccctcatacaagaagctccccctcctcattttcccctcccaccgcagggcccccttgctcagtgctacaggggacaggggcttctcagtcttgccacagtgctctccctatcccagccacccccccaacacaggctcaacctgcaatgacacctgcctctgcatctccctcctggggatcccactccaccccacccctggccccggcaacccccactccctcacagcagtgcccccaggactctcctgggctgcgggtaggccctttgatccctgaacaggattatgagcggctggaggactgtgaccctgaggggtcccaagactcacccatccacggggaggagcagcaacccctgcttcatgtccctgaagggctccgaggctcctggcatcacatccagaacctggacagtttcttcaccaagatctacagctaccaccagcggaatggctttgcctgcatcttgctggaggatgtcttccagctgggacaatttattttcattgtcaccttcacaaccttcctccttcgatgcgtggattacaatgttctctttgccaaccaaccaagtaaccataccagacctgggccgttccacagcaaagtgaccctgtcagatgccatcctaccctcagcccagtgtgctgagaggatccgctccagcccgctgctggtcctcctcctggtcctggctgccggcttctggctggtccaactgcttcgctcagtctgcaacctcttcagctactgggacatccaggtgttttacagggaggccctgcacatccccccggaggagctgagctcggttccctgggcagaggtgcagtcccgcctcttggcactgcagcggagcgggggcctgtgcgtgcagccgcggcccctgacggagctggacatccaccaccgcatcctgcgctacaccaactaccaggtggcgctggccaacaaaggcctgctgccggcccgctgcccgctgccctggggaggcagtgcggctttcctcagccgcggcctggcgctcaatgtcgacctgctgctcttccgcggtcccttctcgctcttccgcgggggctgggagctgccgcacgcctacaagcgcagcgaccagcggggcgccctagcagcgcgctgggggcgcacagtgctgctgctggccgccctgaacctggcgctgagcccgctggtgctggcctggcaggttctgcacgtcttctatagccacgtggagctgctgcggcgcgagcctggcgcgctgggggcgcgcggctggtcccgcctggcgcgcttgcagctgcgccacttcaacgagctgccgcacgagctgcgcgcgcgcctggcccgcgcctaccgccccgccgccgccttcctgcgcaccgctgcgccccccgcgcccctgcgcacgctgctggcccgccagctcgttttcttcgcgggtgcactcttcgccgcgctgcttgtgctcaccgtctacgacgaggacgtgctagccgtggagcacgtgctcaccgccatgaccgcgctcggggtcaccgccaccgtcgccaggtctttcattccggaagagcagtgccagggtcgtgcgccgcagctcctgctgcagacagccctggcccacatgcactacctcccggaggagcccggccccggcggcagggaccgcgcctaccggcagatggcgcagctgctgcagtaccgagcggtctccctcctggaggagctcctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggacaccctcagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcggcccctccaccccgggggtgctcagcaactgcacctcgcccctgcctgaggccttcctggccaacctcttcgtgcaccctctcctgcctccgagagatctgagcccgacagccccctgtccagctgcggccacagccagcctccttgcctccatttcccgaattgcccaggaccccagctctgtgtccccaggaggcactgggggccagaagctggcccagctcccagaacttgcttctgccgagatgagtctccatgtcatctacctgcaccagcttcaccagcagcagcagcagcaggagccgtggggtgaggctgcagcctccatcctgtccaggccctgctccagcccctcacagccaccctcgcctgatgaggagaagccatcctggtcaagtgacggctccagtcctgcctctagccccagacaacagtggggaacccagaaggcccggaatctgttccccggagggtttcaggtgaccacagacacccagaaggagcctgaccgggcctcttgcactgactgagacgactcctcagggccccactcctggcagctgagtgctgcacctgccttctcgatcacgagcctgagaactgcacgggggagcagcccagactggctggaaaccatgttttcagagtgcagggtcaagtggcgtcctctggacagatgtgagaaggcaccacctcaagaggggaggagcggggctgatcctggtcgggcggacctgagtcgggcagccgctctcccggaactggaagggaaagccaggcggctctcaggggctgttggtgtctgagccgggagggtcgaacgcccagggcactgcgccccgcaactgacgctcctgcaaggaaaagctctggcacgccgatgacgtcgccggcctcgtccagctccatgtcgccctccgtcgccaggatgcgctgcacggtctgcaggacgttggttgccatggtaacatcgccgcagacaaacatgtggccccgctcgaggcacagcacgcggtgcacctccgcagccagctccgtcctcaggatgtcctgcacgttaccattgcgccctcagggtctcacaccttggggttgtcaggttcccgggagaaggcggtgaggactcggccaaacaccccgcgctgctgggcgttctgcacctcgtcgcggtagagatggtcaagttgggagcatcggcagccgaacaccaaagtcatgggagtgggctgcagccctgcaagcaaccccgcgcttgggaaggctcttctccggggcacagtgctagtggggcctccccacaggccaccgtcgcccagcctggcagcccagcgttttgggctgaaaccaccattactttggctgtttcatctctaagagagtgtagaatgctttcacagagaccctgcacagccctgatttacagagggaagggaagcgcgggtgaggtggtggcccctggtggagctgcgctagaatgcgcggcttcggactcagaattccatgccctttgcattgtgtgacatcgcagtccccttccccgctcccacttcatattctcccatacttataactctcctcccagtcacagccctcttcttttgattgacagaccaccctgggcaccccatgctcaatatgaacaccttgtagcatccttaggtcttggacagacctcggtcagctctggcacagtcaagaatccaccttgggcagttcttctttgagtcttagccctaatccctttgaaaattctattttcctttgtcctcaatccagtcaacacctactatgtaccaggcaccaggaagccagaagctcagggcccagcccttgcctttggtacctgccctccccttggtctcatgagcgtcttttcagctttgtggactttgtttcctgccctctctttcctatttcctgccttccagccccacccctctgtccctagattgtgtgactcccttcaggcagtcctttagtccccagcctcacctttgctctcaatgtcatgcagccgctcctgccagaatccccggaagggggcaatgccagtgcctggacccaccaggatgcagggcaagctgggatcgggtggcagccggaaggagggagccctggcaggagagacactccatcaggtcccctttgcctttcctgctccaccattctcaccatgcagggtgggtggagcaaggaggacccaagttcttcccatctcaaaaaaaaattaaaaaaaaaacaaaaaacaaaa

SEQ ID NO: 110546 - DNA, 3489 bp, Homo sapiens
  Payload ID: 1679
  Gene Symbol: ATG9B
  Gene Name: autophagy related 9B
  Uniprot ID: Q674R7
  ENST ID: ENST00000469530
  CDS Start-End: 1-2775
atggtgagccgaatgggctggggggggagaagaaggcggctggggcggtggggagatctggggcccggatcggtgcccctcctccccatgccactgccacctcctcctcctccttcatgccggggacctgggggagggaggatctccatcttctctctgtcccctgcccctcatacaagaagctccccctcctcattttcccctcccaccgcagggcccccttgctcagtgctacaggggacaggggcttctcagtcttgccacagtgctctccctatcccagccacccccccaacacaggctcaacctgcaatgacacctgcctctgcatctccctcctggggatcccactccaccccacccctggccccggcaacccccactccctcacagcagtgcccccaggactctcctgggctgcgggtaggccctttgatccctgaacaggattatgagcggctggaggactgtgaccctgaggggtcccaagactcacccatccacggggaggagcagcaacccctgcttcatgtccctgaagggctccgaggctcctggcatcacatccagaacctggacagtttcttcaccaagatctacagctaccaccagcggaatggctttgcctgcatcttgctggaggatgtcttccagctgggacaatttattttcattgtcaccttcacaaccttcctccttcgatgcgtggattacaatgttctctttgccaaccaaccaagtaaccataccagacctgggccgttccacagcaaagtgaccctgtcagatgccatcctaccctcagcccagtgtgctgagaggatccgctccagcccgctgctggtcctcctcctggtcctggctgccggcttctggctggtccaactgcttcgctcagtctgcaacctcttcagctactgggacatccaggtgttttacagggaggccctgcacatccccccggaggagctgagctcggttccctgggcagaggtgcagtcccgcctcttggcactgcagcggagcgggggcctgtgcgtgcagccgcggcccctgacggagctggacatccaccaccgcatcctgcgctacaccaactaccaggtggcgctggccaacaaaggcctgctgccggcccgctgcccgctgccctggggaggcagtgcggctttcctcagccgcggcctggcgctcaatgtcgacctgctgctcttccgcggtcccttctcgctcttccgcgggggctgggagctgccgcacgcctacaagcgcagcgaccagcggggcgccctagcagcgcgctgggggcgcacagtgctgctgctggccgccctgaacctggcgctgagcccgctggtgctggcctggcaggttctgcacgtcttctatagccacgtggagctgctgcggcgcgagcctggcgcgctgggggcgcgcggctggtcccgcctggcgcgcttgcagctgcgccacttcaacgagctgccgcacgagctgcgcgcgcgcctggcccgcgcctaccgccccgccgccgccttcctgcgcaccgctgcgccccccgcgcccctgcgcacgctgctggcccgccagctcgttttcttcgcgggtgcactcttcgccgcgctgcttgtgctcaccgtctacgacgaggacgtgctagccgtggagcacgtgctcaccgccatgaccgcgctcggggtcaccgccaccgtcgccaggtctttcattccggaagagcagtgccagggtcgtgcgccgcagctcctgctgcagacagccctggcccacatgcactacctcccggaggagcccggccccggcggcagggaccgcgcctaccggcagatggcgcagctgctgcagtaccgagcggtctccctcctggaggagctcctgtccccgctcctcaccccgctgtttctgcttttctggttccgccctcgtgccctggagattatcgacttttttcatcacttcactgtggatgtggctggggttggggacatctgttcctttgcccttatggatgtgaagcgccacggacaccctcagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcggcccctccaccccgggggtgctcagcaactgcacctcgcccctgcctgaggccttcctggccaacctcttcgtgcaccctctcctgcctccgagagatctgagcccgacagccccctgtccagctgcggccacagccagcctccttgcctccatttcccgaattgcccaggaccccagctctgtgtccccaggaggcactgggggccagaagctggcccagctcccagaacttgcttctgccgagatgagtctccatgtcatctacctgcaccagcttcaccagcagcagcagcagcaggagccgtggggtgaggctgcagcctccatcctgtccaggccctgctccagcccctcacagccaccctcgcctgatgaggagaagccatcctggtcaagtgacggctccagtcctgcctctagccccagacaacagtggggaacccagaaggcccggaatctgttccccggagggtttcaggtgaccacagacacccagaaggagcctgaccgggcctcttgcactgactgagacgactcctcagggtcagtattgcctcctgtgaggggagggagaaaggacggcataggtagttggtttggagtccgacttgaagcgatgggagcagtggtgggaatttggggtgatgggaggtggtcatctctggaatctagacccctggactgcttgccaagagccgtctcctcccacaggtaccctggcttcggcagccacaggagattggagggtggagtagaaaaacacaaggagtcattgttagaggccccatagatgacaggcccaggtgctttagttgggcaggacctgggagtcagtgaggaactcgccccgagaacagagaaaaggtaggcaaggagaggagatgctgatggcatctggaaacaagtcttagagatggtctgcacccagagggaataaggggagacatccccaactggaatgtgtcctggagcagctgcctgggaagaagtcctcgagtttcctcaaggtgggggacagaggtcaaggatgaggccgagctaaatggaagggcgacagtgaggcaggtgggctttaaggctgtggattcgtcatgctggcggctgccagcagcactttcaggttccttggggcttgtaggggatggggacttgtcagtggaaagacgggagggatgatgtttttggacttcagtacgggtgtgatgtcccaggaagtgggtgtggctccccatcctgtatgaaa

SEQ ID NO: 110547 - DNA, 5023 bp, Homo sapiens
  Payload ID: 1680
  Gene Symbol: AMBRA1
  Gene Name: autophagy/beclin-1 regulator 1
  Uniprot ID: Q9C0C7
  ENST ID: ENST00000314845
  CDS Start-End: 361-3987
aggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 110548 - DNA, 5351 bp, Homo sapiens
  Payload ID: 1680
  Gene Symbol: AMBRA1
  Gene Name: autophagy/beclin-1 regulator 1
  Uniprot ID: Q9C0C7
  ENST ID: ENST00000458649
  CDS Start-End: 420-4316
aaatgaagggcccttaatcataagcaatttcctagttacacgacctcagtgctcccagaaggggattaatgaagagccaccagactatctttatggagaatctagattgggaagttaagctaagaatgtgcatttttgaaaaagtttttatggtagaagagaatgtatatcagaggaaagaatgtagagaagaaagcaacattgtccactgggaattgataagttctgcgtagaatttagagttataaggactatctcattggctcctaatgaatgctaaataacaaatggaaattgctatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccct

SEQ ID NO: 110549 - DNA, 522 bp, Homo sapiens
  Payload ID: 1680
  Gene Symbol: AMBRA1
  Gene Name: autophagy/beclin-1 regulator 1
  ENST ID: ENST00000526606
  CDS Start-End: 451-522
gagctgtttttcggcgctcggctgtggttccttgaacgattgcttgggcgttcctcctttgatgtctggggcgttcttgtattcggtgatcttttgcgccgtcttcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagtggagaagagaaagagaaaatgagtgagaaagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatggga

SEQ ID NO: 110550 - DNA, 5067 bp, Homo sapiens
  Payload ID: 1680
  Gene Symbol: AMBRA1
  Gene Name: autophagy/beclin-1 regulator 1
  Uniprot ID: Q9C0C7
  ENST ID: ENST00000534300
  CDS Start-End: 315-4031
tcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggaggaggctgctggaatcttccctcatttcattatcccgttatgatggagcaggatccagagagcacccaatttacccagacccagcgagggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 110551 - DNA, 4817 bp, Homo sapiens
  Payload ID: 1680
  Gene Symbol: AMBRA1
  Gene Name: autophagy/beclin-1 regulator 1
  ENST ID: ENST00000533727
  CDS Start-End: 242-3781
gccgccttctcctgccggtcggtagaacggaccccttcctttattcctgtctcctctttctttttccctgtggctcagcccgttcgctggactgcaaaccgagctcccgtctgccttgcagatttccatgaggacaacttacaaggacctgtatggcctcattttagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactgggaactggacatgtggaagagctgctggctgcatcagggaacaggaggaggaagagggtcagggtggagaggaagatcagtcagtgggcacaagacagtcaaatgggcaaggcctgcctcggggaactagaaccttccaggatctggagcccgggagagccacactgtgggcttaatgtgaatagaggaacaagtgggtatctctgccaggcaccccactttctcctagtaacatgggctcaggggactcagccctggacagagagcctccagagagtgaacagtcttccagatctgggccaatcatcctggacagaggcccgcgaggcagctttgccctgtccacctgttgggtgggcagagccaccaggaacccagacaccacctccaactctgagccttccagagcttcagcctctcttcgtcgtcttaccccactgaaaccaacagggatcgggccaggctcccagattcttgaggacagggacttcggcatttactaatgggggactactgtggggtaagggggcgcctgcttgcctgatacaggatggggtcaagggacagtgggcaggtcctcactcaggagtggggggtgtaggctggccagcccccagggcttgtccaccagtcttctccccgcaaggccctcagagcagcgcctgtgggtgtcagtattacctgagcctaggccaaagctagcccaaggctggggaaggggaggagactccaggtcagaatgtgaggtctcagtctgtgatttaaggtgttgcatgtggactcttaactgtacgtgtagtttctagtggagaaatcaaggctctgatcattttgtttttagtatgaaaatgtgatttcctttctgtttgtaactcatcatagaaacattgtggtgggaggagaggggatagtctacagctaatgagggaaacaccaaagatcacatcattaaaatgatgacatgcccctc

SEQ ID NO: 110552 - DNA, 4102 bp, Homo sapiens
  Payload ID: 1680
  Gene Symbol: AMBRA1
  Gene Name: autophagy/beclin-1 regulator 1
  Uniprot ID: Q9C0C7
  ENST ID: ENST00000528950
  CDS Start-End: 293-4102
attcggtgatcttttgcgccgtcttcttgcttgatgtctcctgagcggcggcggcgccgggtcgagggctgagttgtccgcgaggccccgcgctcaagccgccttctcctgccggtcggtagaacggaccccttcctttattcctgtctcctctttctttttccctgtggctcagcccgttcgctggactgcaaaccgagctcccgtctgccttgcagctgcttcagtgtgttggagctgttacttgctccttcatttcctgggcctggtgtgacagtggctactgagcgccatgaaggttgtcccagaaaagaatgctgtccggatactctgggggcgagaacggggtgctcgggccatgggagctcagcggcttctgcaggagctggtagaagataaaacccggtggatgaaatgggagggcaagagagtagaactgccggatagtccacgctctaccttcttattggccttcagcccagacaggactctcttagcctccacccatgtgaaccataatatctatattacggaggtgaagactggcaagtgtgttcattccctgattggacaccgccgtactccatggtgtgtcacttttcatcccaccatctcaggccttattgcttctggctgcctagatggggaggttaggatttgggatttacacggtggcagtgaaagctggttcacagatagcaacaatgccattgcctccctggctttccaccctacggctcagctcctgctgattgccactgccaatgagatccacttctgggactggagtcgacgggaaccctttgctgtggtgaagacagctagtgagatggaacgggtccgtctggtgagatttgatccacttggacactacttactcacagcaattgttaacccctctaatcaacagggtgatgacgaaccagagatccccatagatggaacagaattatcccactaccgtcagcgtgccctcctgcaatcacagccagttcgccggacgcctctcctccacaatttcctgcacatgctgtcctcccgctcttctggcatccaggtgggagagcaaagcacagtgcaagattctgctaccccctcacccccaccgcctccccctcagccctccacggagcgccccaggacttccgcttacatcaggctccgacagcgggtcagttaccccacagctgagtgctgccagcaccttgggatcctgtgcctttgcagccgctgctctggcactcgagttccttccctcttgccacaccaggacagtgtcccccctgcttctgccagagctactaccccttccttttcttttgtacagaccgagcccttccatcccccggagcaggcctcgtcaacgcagcaggaccagggcctcctgaaccggccgtctgccttcagtacagtccagagcagcactgccggcaacacgctccgcaacctcagtctgggtcctacccgccgctctttgggagggcctctgtctagccacccttctaggtatcaccgagaaatagctcctgggttgacaggatctgagtggacccggacagtactcagtctgaactcccgctctgaggcggaatccatgcccccgcccagaaccagtgcctcttcggtgagtttgctgtctgtgctgagacagcaggaaggtggctctcaggcatctgtgtacacttcagccacagaagggaggggttttccggcatcagggttggcaactgagtcagatggagggaatggctccagccaaaacaactcgggcagcattcgccatgagcttcagtgtgacctgagacgcttctttctggagtatgaccggcttcaggagctggatcagagcctgagtggggaagctccccagacccaacaggcccaggaaatgctcaacaataacattgaatctgagaggccaggcccttcccaccagcccaccccacacagcagtgagaacaactccaacctgtcccgtggccacctgaatcgctgtcgtgcttgccacaatctcctgaccttcaacaacgataccctgcgctgggaaagaaccacacctaactactcctctggcgaggctagttcctcttggcaggtccccagctcctttgagagtgtgccatcaagtggcagccagttgccacctctcgagcggactgagggccaaacgcccagctccagcaggctggagttgagcagctctgctagtccgcaggaggagaggactgtgggggtggcctttaaccaggagacaggccactgggaaagaatttacacccagtccagcagatctggaactgtgtcacaggaggccttacatcaggatatgcctgaggagagctctgaggaggattcactcaggagattatctcctgctgcatactacgcccagaggatgatccagtatctctcacggagagacagtattcgccagcgctccatgcgctaccaacagaaccgtctccgttcttccacctcctcctcttcctcagacaaccagggtccatcagtagagggaaccgacttggaatttgaggactttgaggacaatggtgacagatccaggcaccgagctccacgcaatgcccggatgtctgcaccttcgcttggacgctttgtcccaaggcgtttcttgctgcctgagtacttgccttatgctgggatttttcatgaacgtggacagcctggcttggctactcactcttctgttaacagggtcctggcaggggcagtgatcggtgatggacagtctgctgtggccagtaacattgccaatactacctaccggctccagtggtgggacttcactaagtttgacctccctgaaatcagtaatgcttccgtgaatgtgctggtgcagaactgcaagatctacaatgatgccagctgtgacatttctgcagatggccagctcctggcagctttcatccccagcagccagaggggctttcctgatgaaggcatcctggcagtgtactccctggccccccataacctgggcgaaatgctctacaccaagcgatttggtcccaatgccatttcggtgagcctgtccccaatgggcagatatgtaatggtgggcttggcctcacgaaggatcctgctgcacccctccacagagcacatggtggcccaggtcttcaggctgcaacaggcccatggtggagagacctccatgaggagagttttcaacgtcctttatcccatgcctgccgaccagcggagacatgtcagtatcaactctgcccgttggctgcctgagccagggcttggcttggcctatggtactaacaaaggagacctggtgatctgccgaccagaggccttaaactctggtgttgagtactactgggaccagctgaacgagacggtcttcactgtccattccaacagcaggagcagcgagcggcctggaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtag

SEQ ID NO: 110553 - DNA, 837 bp, Homo sapiens
  Payload ID: 1680
  Gene Symbol: AMBRA1
  Gene Name: autophagy/beclin-1 regulator 1
  ENST ID: ENST00000526545
  CDS Start-End: 1-771
aactctgcccgttggctgcctgagccagggcttggcttggcctatggtactaacaaaggagacctggtgatctgccgaccagaaaccagcagagccacatggaggacagacagagacatggggctgatgaatgccattgggcttcagccccggaaccctgccacctcagtgacatctcagggcacccagactctggcccttcagctgcagaatgccgaaacacagactgagagggaggtgccggagccagggacagccgcctcaggtcctggtgaaggtgagggttcagagtatggtgccagtggagaagatgcgctcagcaggatccagaggctgatggcggagggcggcatgacagccgtggtgcagcgggagcagagcaccaccatggcctccatgggcggcttcggcaacaacatcatcgtcagccaccgcattcaccgcagctctcagacgggcactgaacctggtgccgcccacacctcctcaccccagccctccacctctcggggactgctcccagaggccgggcaactggcagagcgaggcctaagcccccggacagcttcctgggaccagcctggtacccctgggcgggagccaacccagccaaccctgccctcttcctcccctgtccccattcctgtttcccttcccagcgctgagggaccaaccctccactgcgagttgaccaataacaaccaccttctggatggtggcagcagcaggggggacgctgcaggccctaggggagaaccacggaacaggtagagacaaacgttgcactggtgcctcccctcgaaccgccaagcagaaaccggacctcacagctgactg

SEQ ID NO: 110554 - DNA, 6982 bp, Homo sapiens
  Payload ID: 1681
  Gene Symbol: AVL9
  Gene Name: AVL9 homolog (S. cerevisiase)
  Uniprot ID: Q8NBF6
  ENST ID: ENST00000318709
  CDS Start-End: 222-2168
gtgtcaggtgacagcccggaagctgcggaagcggatgagggaagggcggccgtggccctgggggcggcgggagctgctttgcctccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttttggggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggatatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcggactttctattaacatttctagctaagagtttgactcttagtggtcactttactgactttccaacataaaacaagtatctcagaagatacaactttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaacgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcctacagttgga

SEQ ID NO: 110555 - DNA, 4336 bp, Homo sapiens
  Payload ID: 1681
  Gene Symbol: AVL9
  Gene Name: AVL9 homolog (S. cerevisiase)
  ENST ID: ENST00000409301
  CDS Start-End: 185-2077
agggaagggcggccgtggccctgggggcggcgggagctgctttgcctccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattagacaatgaaaagatattatcggactatgggacaacttttgttacagcatggaagaatactcacaactacagggtgtggaacagcaacaagcatccagcacttgcagaaataaatccaaattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttttggggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggatatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaa

SEQ ID NO: 110556 - DNA, 6372 bp, Homo sapiens
  Payload ID: 1681
  Gene Symbol: AVL9
  Gene Name: AVL9 homolog (S. cerevisiase)
  ENST ID: ENST00000446718
  CDS Start-End: 1-1707
caggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacactgcaattagttctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttctgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttttggggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggatatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatgctgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcggactttctattaacatttctagctaagagtttgactcttagtggtcactttactgactttccaacataaaacaagtatctcagaagatacaactttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaacgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 110557 - DNA, 3643 bp, Homo sapiens
  Payload ID: 1682
  Gene Symbol: AXIN1
  Gene Name: axin 1
  Uniprot ID: O15169
  ENST ID: ENST00000262320
  CDS Start-End: 373-2961
ctcgggaggcgatcgtggccgctgccgccgccagagccggccggagtcggcccggagccgcgtccacgcggagcgggcgggtgggagctggcggctgggcccctgcggcgcccccgcggcctgccccgcgtccgcctccgggccgccgagccgcagccgccgagatgggggccgccccgggccgcgcccccgccgggtcccgcccgccgcgctgccgctgagcgcatgggcccggaccgcgccgcgccgctccgggagccgggcccggggtcccgccaccaccgcgcgcgggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtatgtgcaggaggttatgcggcggggacgcgcctgcgtcaggccagcgtgcgcgccggtgctgcacgtggtaccagccgtgtcggacatggagctctccgagacagagacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgc

SEQ ID NO: 110558 - DNA, 3324 bp, Homo sapiens
  Payload ID: 1682
  Gene Symbol: AXIN1
  Gene Name: axin 1
  Uniprot ID: O15169
  ENST ID: ENST00000354866
  CDS Start-End: 163-2643
gctgccgctgagcgcatgggcccggaccgcgccgcgccgctccgggagccgggcccggggtcccgccaccaccgcgcgcgggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtggatgggatccccccatacaggatccgtaagcagcaccgcagggagatgcaggagagcgtgcaggtcaatgggcgggtgcccctacctcacattccccgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctg

SEQ ID NO: 110559 - DNA, 334 bp, Homo sapiens
  Payload ID: 1682
  Gene Symbol: AXIN1
  Gene Name: axin 1
  ENST ID: ENST00000457798
  CDS Start-End: 1-308
gtctggaggaggaagaaaagagagccagccgagcaccctccaagcagaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacaggcctccttcccatctgcggtgctgcctgctcactgccctcctcacctccgtcctgcagatactacttcaagaaagtgagcgacgagtttgactgtggggtggtgtttgaggaggttc

SEQ ID NO: 110560 - DNA, 4259 bp, Homo sapiens
  Payload ID: 1683
  Gene Symbol: AXIN2
  Gene Name: axin 2
  Uniprot ID: Q9Y2T1
  ENST ID: ENST00000307078
  CDS Start-End: 315-2846
cggctgtgattggcgcggcgggatcactggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccatagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaa

SEQ ID NO: 110561 - DNA, 2541 bp, Homo sapiens
  Payload ID: 1683
  Gene Symbol: AXIN2
  Gene Name: axin 2
  ENST ID: ENST00000375702
  CDS Start-End: 110-2446
gttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaa

SEQ ID NO: 110562 - DNA, 621 bp, Homo sapiens
  Payload ID: 1683
  Gene Symbol: AXIN2
  Gene Name: axin 2
  ENST ID: ENST00000544103
  CDS Start-End: 170-621
ggggggaggtcagggaagacagaggtgttgactgagctggattcttggtggggagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcc

SEQ ID NO: 110563 - DNA, 1034 bp, Homo sapiens
  Payload ID: 1683
  Gene Symbol: AXIN2
  Gene Name: axin 2
  ENST ID: ENST00000585045
  CDS Start-End: 460-1034
caagtccggggcgcccgtgtccctcgcgtccctcctcccggcccgggcccctcgcccgtggccgccccggccccttttgcggagaggcagagactccgcgcgtcgccatttctggactaggctgctgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgac

SEQ ID NO: 110564 - DNA, 1060 bp, Homo sapiens
  Payload ID: 1683
  Gene Symbol: AXIN2
  Gene Name: axin 2
  ENST ID: ENST00000580513
  CDS Start-End: 484-1060
gttaaatccacagcgcagtttttgttggaagcgcccggaggacatttggtgcgccgagtgactgctggaaacaggacctgcgttgaaagccgggccgggcgggggcggaggcccgctcggatcttttgcataaaaggggcggcggggcgcgccgttccccctccccggccggtggctttcgctctgaacccgggattgttgtttcccgcaccccctcccccgccgcacgactccccatgttccccgacgccgcggccggcccgggggggcccggggctgccgccgcgagccgagccgggggccggggccgggcccctgccaggggcgcctgcgaggtctcgccgccgagcgcgcgcggggatcaatgagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgactt

SEQ ID NO: 110565 - DNA, 976 bp, Homo sapiens
  Payload ID: 1683
  Gene Symbol: AXIN2
  Gene Name: axin 2
  ENST ID: ENST00000577278
  CDS Start-End: 162-976
gggcagataccccccgggggtcgcgtcgctgtcgcggttatggatagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacag

SEQ ID NO: 110566 - DNA, 4060 bp, Homo sapiens
  Payload ID: 1683
  Gene Symbol: AXIN2
  Gene Name: axin 2
  ENST ID: ENST00000618960
  CDS Start-End: 315-2651
cggctgtgattggcgcggcgggatcactggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtccttcaagaggagcgatcctgttaatccttatcacataggttctggctatgtctttgcaccagccaccagcgccaacgacagtgagatatccagtgatgcgctgacggatgattccatgtccatgacggacagcagtgtagatggaattcctccttatcgtgtgggcagtaagaaacagctccagagagaaatgcatcgcagtgtgaaggccaatggccaagtgtctctacctcatttcccgagaacccaccgcctgcccaaggagatgacccccgtggaacccgccacctttgcagctgagctgatctcgaggctggaaaagctgaagctggagttggagagccgccacagcctggaggagcgcctgcagcagatccgagaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttggtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgctgtgtggccagtcagcagagggacaggaatcattcggccactgttcagacgggagccacacccttctccaatccaagcctggctccagaagatcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttc

SEQ ID NO: 110567 - DNA, 1019 bp, Homo sapiens
  Payload ID: 1683
  Gene Symbol: AXIN2
  Gene Name: axin 2
  ENST ID: ENST00000611991
  CDS Start-End: 490-972
cggaggctcagtctgcgcgcaggaccggcccaagtccggggcgcccgtgtccctcgcgtccctcctcccggcccgggcccctcgcccgtggccgccccggccccttttgcggagaggcagagactccgcgcgtcgccatttctggactaggctgctgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagacttttgtcatgacattttgttctacttatactgtaaattatgcattataaagagttcatttaaggaaaattacttggtacaataattattgtaattaagagatgtagcctttattaaaattttatatttttc

SEQ ID NO: 110568 - DNA, 3008 bp, Homo sapiens
  Payload ID: 1684
  Gene Symbol: AIDA
  Gene Name: axin interactor, dorsalization associated
  Uniprot ID: Q96BJ3
  ENST ID: ENST00000340020
  CDS Start-End: 208-1128
cggggtctcggcggggcggtcgctttggagccgcaaagtttggctgtggcggcaaatgggcttgggcggctcctcggcgggtggcggtggtggccgtagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtactttattaccaaggttgccatcggaaccaggaatgacattactcactatcagaattgagaaaattggtttgaaagatgctgggcagtgcatcgatccctatattacagttagtgtaaaggatctgaatggcatagacttaactcctgtgcaagatactcctgtggcttcaagaaaagaagatacatatgttcattttaatgtggacattgagctccagaagcatgttgaaaaattaaccaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactcctaccctgcttcctggaacaatactgttgtgggtaggatgtgctcatcttcagacttaatacagcaataagaatgtgctagagtttacacatctgttcacttttgctccaatatgctcttttgacttaacgtcaagctttgggttgatgtgggtagggtagtgtcaaactgctttgagaggaatgggaccagttctgctgcctaagaaggtctgtctggatgtttataggcagcacctctgaagtggcctaaattcaccctgatctgatagttttcctgcttagaaagtgtgccttggccagatcagtatcccacatgggagtgttccctaggttgtagctgtgattgtttccagatgaccagattgtttttctgaaaatgagcatatttttagtcatgtcgattagctgttcttctacatcacattgttactctttctgatgatgattctagggttaacattggaaccatctcaaaataattacaaagttttagatgggtttacaatgtcttctaaacaatgtaatctaaaaataattgagtcagatgctaacgagatactgcaggcataactgctgtttttctgacaactgattgtgaaaccttaaaacctgcatacctcttcttacagtgaggagtatgcaaaatctggaaagatattctattttttttatataggtagataggatcgccatttatttcctatttagatatactgacattcatccatatgaaaatatgcaggtcattagcttactataatttacttttgacttaatggggcataaataaaactttcatagtacacatgaggtggatatttgatacacagaacatttgcggtgggctttctgtgggttagatgtaaagcccacatattttaatattcactattttaaatgagcaatgcatgaggggaatgcagtgtcagtacctggcctatttttaaactagtgtaatcaccctagtcataccattcagtatgtttgctttttaaaataagtaaccacaactaagttgttgtagcccttgcacttcaagagatctagtctttactttcagttgtctgttaggtccattctgtttactagacggatgttaataaaaactatgcgagcctgaatgaattctcagccaaatttagtcttgtctctcatcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgcttggcagcactctgtaccctgtggagtactcagtaccttttgtttgatgttgctgacaagacctgaaaaaaaatcccttaaaaaaaaaacccattaaagtgtagcaaaaccgatgtattattttttctcttttctcataaaccataagatatgtatatcaaaatgataatttatatgaagcatctgctatccttcacataagtatagtttatatgaactacaaatacctttcatcaacattaaagaagcttaaattgaa

SEQ ID NO: 110569 - DNA, 1072 bp, Homo sapiens
  Payload ID: 1684
  Gene Symbol: AIDA
  Gene Name: axin interactor, dorsalization associated
  Uniprot ID: Q96BJ3
  ENST ID: ENST00000355727
  CDS Start-End: 112-786
tagcggttcctcctggccctgttaatgtcggggccaggccgggggaggatggcgccctagaacccggccttgctggggtaggggcgggaggggacggggtggggaccggccatgtcggaggtgacccggagtctgctgcagcgctggggcgccagttttaggagaggcgccgacttcgactcttggggccagctggtggaggcgatagacgagtatcagatattagcaagacatctacaaaaggaggcccaagctcaacacaataattctgaattcacagaagaacaaaagaaaaccataggcaaaattgcaacatgcttggaattgcgaagtgcagctttacagtccacacagtctcaagaagaatttaaactggaggacctgaagaagctagaaccaatcctaaagaatattcttacatataataaagaattcccatttgatgttcagcctgtcccattaagaagaattttggcacctggtgaagaagagaatttggaatttgaagaagatgaagaagagggtggtgctggagcagggtctcctgattcttttcctgctagagttcccggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattattgaccaagaaaccactttatcttcatctacatcaaactttgcacaaggaatgatcctgacatgatgaacctggaacttctgtgaattttaccactcagtagaaaccatcatagctctgtgtagcatattcacccttcaacaggcaggaagcaagccgtacccagaccagtaggccggacggagtccaatgcaaagctgtaccacagaattcagagtccagcacatcacactgacgtataggactccttgggatacaggtttattgtagattttgaaacatgtttttacttttctattaattgtgcaattaatagtctattttctaatttaccactactc

SEQ ID NO: 110570 - DNA, 4737 bp, Homo sapiens
  Payload ID: 1685
  Gene Symbol: AXL
  Gene Name: AXL receptor tyrosine kinase
  Uniprot ID: P30530
  ENST ID: ENST00000301178
  CDS Start-End: 191-2875
gggaaggaggcaggggtgctgagaaggcggctgctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggcctactttttttttttttttttttttttttttttttgcgatagagtctcactgtgtcacccaggctggagtgcagtggtgcaatctcgcctcactgcaaccttcacctaccgagttcaagtgattttcctgccttggcctcccaagtagctgggattacaggtgtgtgccaccacacccggctaatttttatatttttagtagagacagggtttcaccatgttggccaggctggtctaaaactcctgacctcaagtgatctgcccacctcagcctcccaaagtgctgagattacaggcatgagccactgcactcaaccttaagacctactgttctaaagctctgacattatgtggttttagattttctggttctaacatttttgataaagcctcaaggttttaggttctaaagttctaagattctgattttaggagctaaggctctatgagtctagatgtttattcttctagagttcagagtccttaaaatgtaagattatagattctaaagattctatagttctagacatggaggttctaaggcctaggattctaaaatgtgatgttctaaggctctgagagtctagattctctggctgtaaggctctagatcataaggcttcaaaatgttatcttctcaagttctaagattctaatgatgatcaattatagtttctgaggctttatgataatagattctcttgtataagatcctagatcctaagggtcgaaagctctagaatctgcaattcaaaagttccaagagtctaaagatggagtttctaaggtccggtgttctaagatgtgatattctaagacttactctaagatcttagattctctgtgtctaagattctagatcagatgctccaagattctagatgattaaataagattctaacggtctgttctgtttcaaggcactctagattccattggtccaagattccggatcctaagcatctaagttataagactctcacactcagttgtgactaactagacaccaaagttctaataatttctaatgttggacacctttaggttctttgctgcattctgcctctctaggaccatggttaagagtccaagaatccacatttctaaaatcttatagttctaggcactgtagttctaagactcaaatgttctaagtttctaagattctaaaggtccacaggtctagactattaggtgcaatttcaaggttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactttgtatatcaacga

SEQ ID NO: 110571 - DNA, 3206 bp, Homo sapiens
  Payload ID: 1685
  Gene Symbol: AXL
  Gene Name: AXL receptor tyrosine kinase
  Uniprot ID: P30530
  ENST ID: ENST00000359092
  CDS Start-End: 159-2816
gctgggcagagccggtggcaagggcctcccctgccgctgtgccaggcaggcagtgccaaatccggggagcctggagctggggggagggccggggacagcccggccctgccccctcccccgctgggagcccaacaacttctgaggaaagtttggcacccatggcgtggcggtgccccaggatgggcagggtcccgctggcctggtgcttggcgctgtgcggctgggcgtgcatggcccccaggggcacgcaggctgaagaaagtcccttcgtgggcaacccagggaatatcacaggtgcccggggactcacgggcacccttcggtgtcagctccaggttcagggagagccccccgaggtacattggcttcgggatggacagatcctggagctcgcggacagcacccagacccaggtgcccctgggtgaggatgaacaggatgactggatagtggtcagccagctcagaatcacctccctgcagctttccgacacgggacagtaccagtgtttggtgtttctgggacatcagaccttcgtgtcccagcctggctatgttgggctggagggcttgccttacttcctggaggagcccgaagacaggactgtggccgccaacacccccttcaacctgagctgccaagctcagggacccccagagcccgtggacctactctggctccaggatgctgtccccctggccacggctccaggtcacggcccccagcgcagcctgcatgttccagggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggttctaggtttcaaagatgctgtgagtctttggttctaaggacctgaaattccaaagtctctaattctattaaagtgctaaggttctaaggc

SEQ ID NO: 110572 - DNA, 2557 bp, Homo sapiens
  Payload ID: 1685
  Gene Symbol: AXL
  Gene Name: AXL receptor tyrosine kinase
  ENST ID: ENST00000593513
  CDS Start-End: 377-2257
agcacacgcgtaaacaacacgcagaactgcagtcgcacttacaagacttggtcccagggccgggcaccgagtggctctgcctgcgatccagcactttgggaggccgaggcgggaggatcgcttggggccagaagtttgagagcagcctgggcaacgtgggctgaacaagacatcctctttctcctgcgaagcccataacgccaagggggtcaccacatcccgcacagccaccatcacagtgctcccccagcagccccgtaacctccacctggtctcccgccaacccacggagctggaggtggcttggactccaggcctgagcggcatctaccccctgacccactgcaccctgcaggctgtgctgtcagacgatgggatgggcatccaggcgggagaaccagaccccccagaggagcccctcacctcgcaagcatccgtgcccccccatcagcttcggctaggcagcctccatcctcacaccccttatcacatccgcgtggcatgcaccagcagccagggcccctcatcctggacccactggcttcctgtggagacgccggagggagtgcccctgggcccccctgagaacattagtgctacgcggaatgggagccaggccttcgtgcattggcaagagccccgggcgcccctgcagggtaccctgttagggtaccggctggcgtatcaaggccaggacaccccagaggtgctaatggacatagggctaaggcaagaggtgaccctggagctgcagggggacgggtctgtgtccaatctgacagtgtgtgtggcagcctacactgctgctggggatggaccctggagcctcccagtacccctggaggcctggcgcccagggcaagcacagccagtccaccagctggtgaaggaaccttcaactcctgccttctcgtggccctggtggtatgtactgctaggagcagtcgtggccgctgcctgtgtcctcatcttggctctcttccttgtccaccggcgaaagaaggagacccgttatggagaagtgtttgaaccaacagtggaaagaggtgaactggtagtcaggtaccgcgtgcgcaagtcctacagtcgtcggaccactgaagctaccttgaacagcctgggcatcagtgaagagctgaaggagaagctgcgggatgtgatggtggaccggcacaaggtggccctggggaagactctgggagagggagagtttggagctgtgatggaaggccagctcaaccaggacgactccatcctcaaggtggctgtgaagacgatgaagattgccatctgcacgaggtcagagctggaggatttcctgagtgaagcggtctgcatgaaggaatttgaccatcccaacgtcatgaggctcatcggtgtctgtttccagggttctgaacgagagagcttcccagcacctgtggtcatcttacctttcatgaaacatggagacctacacagcttcctcctctattcccggctcggggaccagccagtgtacctgcccactcagatgctagtgaagttcatggcagacatcgccagtggcatggagtatctgagtaccaagagattcatacaccgggacctggcggccaggaactgcatgctgaatgagaacatgtccgtgtgtgtggcggacttcgggctctccaagaagatctacaatggggactactaccgccagggacgtatcgccaagatgccagtcaagtggattgccattgagagtctagctgaccgtgtctacaccagcaagagcgatgtgtggtccttcggggtgacaatgtgggagattgccacaagaggccaaaccccatatccgggcgtggagaacagcgagatttatgactatctgcgccagggaaatcgcctgaagcagcctgcggactgtctggatggactgtatgccttgatgtcgcggtgctgggagctaaatccccaggaccggccaagttttacagagctgcgggaagatttggagaacacactgaaggccttgcctcctgcccaggagcctgacgaaatcctctatgtcaacatggatgagggtggaggttatcctgaaccccctggagctgcaggaggagctgaccccccaacccagccagaccctaaggattcctgtagctgcctcactgcggctgaggtccatcctgctggacgctatgtcctctgcccttccacaacccctagccccgctcagcctgctgataggggctccccagcagccccagggcaggaggatggtgcctgagacaaccctccacctggtactccctctcaggatccaagctaagcactgccactggggaaaactccaccttcccactttcccaccccacgccttatccccacttgcagccctgtcttcctacctatcccacctccatcccagacaggtccctccccttctctgtgcagtagcatcaccttgaaagcagtagcatcaccatctgtaaaaggaaggggttggattgcaatatctgaagccctcccaggtgttaacattccaagactctagagtccaaggtttaaagagtctagattcaaaggt

SEQ ID NO: 110573 - DNA, 3642 bp, Homo sapiens
  Payload ID: 1686
  Gene Symbol: AXDND1
  Gene Name: axonemal dynein light chain domain containing 1
  Uniprot ID: Q5T1B0
  ENST ID: ENST00000367618
  CDS Start-End: 388-3426
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaa

SEQ ID NO: 110574 - DNA, 2835 bp, Homo sapiens
  Payload ID: 1686
  Gene Symbol: AXDND1
  Gene Name: axonemal dynein light chain domain containing 1
  ENST ID: ENST00000434088
  CDS Start-End: 1-2619
ctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagcaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaa

SEQ ID NO: 110575 - DNA, 3638 bp, Homo sapiens
  Payload ID: 1686
  Gene Symbol: AXDND1
  Gene Name: axonemal dynein light chain domain containing 1
  ENST ID: ENST00000457238
  CDS Start-End: 388-2406
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaagatcctgaatgagaaaaaagaagagtttactggggatgttctactgtcaaaatacgatactctcaagattattaaacatttacaggaaaactgggcagatattgggcttgggatatttaatcggcataaaagtttggagggggagatgccatcagagcgacagtacatggaggaaattatcaaaaacatacaaaaactctacaaagaatatgaaataagaataaatggggacaatggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggttgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattg

SEQ ID NO: 110576 - DNA, 586 bp, Homo sapiens
  Payload ID: 1686
  Gene Symbol: AXDND1
  Gene Name: axonemal dynein light chain domain containing 1
  ENST ID: ENST00000508229
  CDS Start-End: 351-586
aggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaa

SEQ ID NO: 110577 - DNA, 3375 bp, Homo sapiens
  Payload ID: 1686
  Gene Symbol: AXDND1
  Gene Name: axonemal dynein light chain domain containing 1
  ENST ID: ENST00000511157
  CDS Start-End: 262-1851
aaaggaggaagtgagcggatgctgggcgggtacgcaatgtgtgggtaggatcgcgggtgtccctttcccgtcattttaaaccaagaagcagtgcgaggcctgcccaactcgcgagtttgtggaactggcgcgcgagagcgctgcctgtggggaaggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaaggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagagatagcactgccggttccaggatttggtcctccaaaaggactatgactgaagatggtggtagtaggaatcttactctcaagatgttttagcagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattgaa

SEQ ID NO: 110578 - DNA, 765 bp, Homo sapiens
  Payload ID: 1686
  Gene Symbol: AXDND1
  Gene Name: axonemal dynein light chain domain containing 1
  ENST ID: ENST00000509175
  CDS Start-End: 311-765
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatga

SEQ ID NO: 110579 - DNA, 553 bp, Homo sapiens
  Payload ID: 1686
  Gene Symbol: AXDND1
  Gene Name: axonemal dynein light chain domain containing 1
  ENST ID: ENST00000511889
  CDS Start-End: 185-553
aaaggaggaagtgagcggatgctgggcgggtacgcaatgtgtgggtaggatcgcgggtgtccctttcccgtcattttaaaccaagaagcagtgcgaggcctgcccaactcgcgagtttgtggaactggcgcgcgagagcgctgcctgtggggaaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataag

SEQ ID NO: 110580 - DNA, 3405 bp, Homo sapiens
  Payload ID: 1686
  Gene Symbol: AXDND1
  Gene Name: axonemal dynein light chain domain containing 1
  ENST ID: ENST00000617277
  CDS Start-End: 388-1977
actggcctggcccgcggcaggaagccccggcgtgagacactttcggattccgtgacaacggcgggattaaacgtttttcttctcctttgctactgaacctatgctgtgacttagaacataagaaactccaagagggtgtagggattgtcttagctgtctccctcctccgccggcaccgctgaaggcagcccctatggagggcgctaaacctcggggccctgggtttctatgacgacaaacaggcgttccagcaaaggaggaagtgagcggatgctgggcgggactatgtggcagcctgcaagtcccagtgcggcgctgatttgtgtctaaattagctttccggaggactatttcaaattactaaagagataggaggcattgtttattatgtctctcccgaaaacgccctccaccccgctaaactctacatcaacatctgagagcaaaaagttaaaagtgtctgtagccaaggaagggacaagaggacttcctgagctaaaggagaaaaaaaatatggtggatcgttcaaaactccttcctacttcccttcagaatgagttcattcccaaagaagttcttctttctctgacctatgcggccaatgctggtccttgtcctgaaaacttactacctcctaagaaaattaaaaccccaaagggcactcttccacgccttgtagaccatgtctggcatcaccctgttcgaaggaataaattcaaatacctgattgaccatcccgtctccctcacaggagctggaagggatatttcttttctgtacgatgtaacatatgccaaaggacagactagggagaaggcagtttgtcccccacatttggcccgttcattacagtcacatgatggtgtcattgtgccccataagccaaagacactaacagatactttgattcctgaagaatttcatattgtgtcaagtacaggagtttcaggtttggagtgttatgatgacaaatacactactctcctcacagatagtgaaaacaggctattgctcttcccatccatgaaacctaataaaagagtagaagtggcccagctgaatgatgtgatggatactatgctagagagggctggtgtggaaaatcaggaatatacaggaccaacgaagatgcacaaactactacatatattgaagaaggaacagaccatttacaacatgatatttcatgaacttattcgacaagtcagtgtggactgtgcagacagaggagaacttctgtctaaagtcagagagaggtatgtgcaaatgcttgaccagattgctcggcagatgattgatttctacaaagacttggtaactcagcgagtgatggaccagcgcattttagaagaattgtataatttcaagcatgttattgaagaactgaccagggaactgtgtctagttcgggcacatgatgtgaaattaacaaaggaaacagaaaaagcccacaaggatttggcacaagctcttttaaatgcggaaaagaatgccaaaatagtagaagaatatcatgacttatatacattacaaagagaaaggatggagaatgatatgaaaaagttagtggcagaaagagatatctggagctcagccacatatgaattggccctgaaggtgattgaaagaaatagagtcatattggctagaagactttaccttaatgaaaaaggctggaataaatacactaagcatttcatcatactgctatcaaacaaggacactgaagaccttgcactgttgcagaagttgacacaaaaatggagaaacttagtgaataaacttaaacaagaggtagaacaaatggaagagtctacaagcgagacactgaaaattgttaaggatgggcttatcaaatggcaggagttcttcaatgaaaaagacattttatcccctaataagggaaatatatttaattcagttcttttagacttcaaacagtggcagaaggttactccaaaattcttccaagtttgattagttctcttgacttctgttctttcaagttggaaaacctggagtttcctgatacgcctcttgaagaatggcaggaaatagatgaaaaaattaatgaaatgaaatcacacttggatatattgttaaaccttactggtattgttccacagcacatagatgtggattctgtttcggtactccaagcgtatatatttaacatgattcaacaatggcttttgaagataggcaatgaaattaacaacggtaacattgaacttcagcaccacatggatgagttacatatatctatgatccagtggatggtaaacttgctgattttaatgatacccaactttactgaccaagactgtctcctaaagttggaggaggaaagtgctgagaaacatgatataggagttgcgcgattggagctagatgcgattgaactgacaaggaagttgtaccaatactccagctatttgagcagttgttgcaaagggatggtaacagcaatggctctgagtaaatccactaactcacacaaaaatgctactgaagacctttatgaggtggataagttgaagaaagaatgttatgaatggatcaacacatgctcttgcctcctttctaatatcaaaggcagaaaaattacattattgacatatgaagaaatagagcggctacttgaagaggaggctgtaaaagaattcattgagcctgaaatagacgagtcttttaaagaagatgaagaagaaagtaaggaggataggaaacttcaggaggaaaataaagagagagcagaagaacaaccttcaacatctacagagaaggaaaaactcattcgattcattggagaagatgaaaatgttcattccaaacctctatttgaaacagatgtgttgtcttcctggagagagtcagctaagcaaggtacattggcccaaaaatatcttgaagcaatggctgtaattgaacatatgcaggagaagttactggaggttgaaaatagagccagacaggcagaggagaagtttgaagatgcatatgagaaacttcatcatacccttataaaaaataaagatctagaggaattagtcatgacatcaagaaaggagtctaaagaagagaaagaaaatcaagatgaaagagaagtaaaagaagaagaagaacaacaagaagaagaagaagtcaggtcagcagaaaattcctcaaaatctccaaagaaaggtcactgaatccaaggcaacctgtggaaagaagaattcagatgtcagtgggagcctccaggtgggaggagagcatgcctaaaccctggtggccattgttctgtactaaggaacaacattccctttgaaaggacattatttgcctgttgtatttaacttcacagtgccttgcaaagagttgtttaacttgcatggtgccacccaataaatatctgtgcaattg

SEQ ID NO: 110581 - DNA, 908 bp, Homo sapiens
  Payload ID: 1687
  Gene Symbol: AZU1
  Gene Name: azurocidin 1
  Uniprot ID: P20160
  ENST ID: ENST00000233997
  CDS Start-End: 12-767
cctgccccgccatgacccggctgacagtcctggccctgctggctggtctgctggcgtcctcgagggccggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctgc

SEQ ID NO: 110582 - DNA, 908 bp, Homo sapiens; identical to SEQ ID NO: 110581
  Payload ID: 1687
  Gene Symbol: AZU1
  Gene Name: azurocidin 1
  Uniprot ID: P20160
  ENST ID: ENST00000620695
  CDS Start-End: 12-767

SEQ ID NO: 110583 - DNA, 1713 bp, Homo sapiens
  Payload ID: 1687
  Gene Symbol: AZU1
  Gene Name: azurocidin 1
  ENST ID: ENST00000592205
  CDS Start-End: 230-682
ggcagaggggaaatggggcctggcccacgggagagctgaggcccacgtttggccaggacagggtggatggaggctggggcctccgcagggaagatggacaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctg

SEQ ID NO: 110584 - DNA, 1713 bp, Homo sapiens; identical to SEQ ID NO: 110583
  Payload ID: 1687
  Gene Symbol: AZU1
  Gene Name: azurocidin 1
  ENST ID: ENST00000633060
  CDS Start-End: 230-682

SEQ ID NO: 110585 - DNA, 3213 bp, Homo sapiens
  Payload ID: 1688
  Gene Symbol: BTLA
  Gene Name: B and T lymphocyte associated
  Uniprot ID: Q7Z6A9
  ENST ID: ENST00000334529
  CDS Start-End: 204-1073
gtctttctgttcactttttttcacaaaatcatccaggctcttcctactctcctctcttaccacctctctcttcttttttttttttttttagttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatc

SEQ ID NO: 110586 - DNA, 726 bp, Homo sapiens
  Payload ID: 1688
  Gene Symbol: BTLA
  Gene Name: B and T lymphocyte associated
  Uniprot ID: Q7Z6A9
  ENST ID: ENST00000383680
  CDS Start-End: 1-726
atgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaa

SEQ ID NO: 110587 - DNA, 11073 bp, Homo sapiens
  Payload ID: 1689
  Gene Symbol: BDP1
  Gene Name: B double prime 1, subunit of RNA polymerase III transcription initiation factor IIIB
  Uniprot ID: A6H8Y1
  ENST ID: ENST00000358731
  CDS Start-End: 264-8138
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 110588 - DNA, 2861 bp, Homo sapiens
  Payload ID: 1689
  Gene Symbol: BDP1
  Gene Name: B double prime 1, subunit of RNA polymerase III transcription initiation factor IIIB
  ENST ID: ENST00000380675
  CDS Start-End: 220-2760
aatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggatcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattttgtctctggggaaatggcggcagcattgagagaaactgtaagactagacacctcaccaaaggagatggtaccagcagagattaatactaaagaaatgcagtcagatttaaaagaaactggaagaagagcc

SEQ ID NO: 110589 - DNA, 5511 bp, Homo sapiens
  Payload ID: 1689
  Gene Symbol: BDP1
  Gene Name: B double prime 1, subunit of RNA polymerase III transcription initiation factor IIIB
  ENST ID: ENST00000514903
  CDS Start-End: 1-1751
caagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagagacccttctgacttgtggaagcaaaaggaagcagtgctgacacccacaagaatttaaggaactgtaaaactagaatttgttcacatgtttcatttctatgtctcctgaagctgtccaatggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 110590 - DNA, 4997 bp, Homo sapiens
  Payload ID: 1689
  Gene Symbol: BDP1
  Gene Name: B double prime 1, subunit of RNA polymerase III transcription initiation factor IIIB
  ENST ID: ENST00000525844
  CDS Start-End: 1-1821
acagatgtgactactgaagaaatgaaacaagaagaaaatttgagtgtaccgtttgaaatgaccacaagtgaacatatccaagatgaaccaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcagagacccttctgacttgtggaagcaaaaggaagcagtgctgacacccacaagaatttaaggaactgtaaaactagaatttgttcacatgtttcatttctatgtctcctgaagctgtccaatggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 110591 - DNA, 5511 bp, Homo sapiens; identical to SEQ ID NO: 110589
  Payload ID: 1689
  Gene Symbol: BDP1
  Gene Name: B double prime 1, subunit of RNA polymerase III transcription initiation factor IIIB
  ENST ID: ENST00000612125
  CDS Start-End: 1-1751

SEQ ID NO: 110592 - DNA, 4997 bp, Homo sapiens; identical to SEQ ID NO: 110590
  Payload ID: 1689
  Gene Symbol: BDP1
  Gene Name: B double prime 1, subunit of RNA polymerase III transcription initiation factor IIIB
  ENST ID: ENST00000614425
  CDS Start-End: 1-1821

SEQ ID NO: 110593 - DNA, 2861 bp, Homo sapiens; identical to SEQ ID NO: 110588
  Payload ID: 1689
  Gene Symbol: BDP1
  Gene Name: B double prime 1, subunit of RNA polymerase III transcription initiation factor IIIB
  ENST ID: ENST00000616093
  CDS Start-End: 220-2760

SEQ ID NO: 110594 - DNA, 2861 bp, Homo sapiens
  Payload ID: 1689
  Gene Symbol: BDP1
  Gene Name: B double prime 1, subunit of RNA polymerase III transcription initiation factor IIIB
  ENST ID: ENST00000613844
  CDS Start-End: 220-2760
aatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattttgtctctggggaaatggcggcagcattgagagaaactgtaagactagacacctcaccaaaggagatggtaccagcagagattaatactaaagaaatgcagtcagatttaaaagaaactggaagaagagcc

SEQ ID NO: 110595 - DNA, 11073 bp, Homo sapiens
  Payload ID: 1689
  Gene Symbol: BDP1
  Gene Name: B double prime 1, subunit of RNA polymerase III transcription initiation factor IIIB
  ENST ID: ENST00000611966
  CDS Start-End: 264-8138
agttgcggcgtcctgtgagcgcggggatgctgggaggagggtgaaatttagccatcggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatcatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctgtgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccaagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtataattcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaacctcggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagccgcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatacacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 110596 - DNA, 11073 bp, Homo sapiens; identical to SEQ ID NO: 110587
  Payload ID: 1689
  Gene Symbol: BDP1
  Gene Name: B double prime 1, subunit of RNA polymerase III transcription initiation factor IIIB
  Uniprot ID: A6H8Y1
  ENST ID: ENST00000617085
  CDS Start-End: 264-8138

SEQ ID NO: 110597 - DNA, 5511 bp, Homo sapiens; identical to SEQ ID NO: 110589
  Payload ID: 1689
  Gene Symbol: BDP1
  Gene Name: B double prime 1, subunit of RNA polymerase III transcription initiation factor IIIB
  ENST ID: ENST00000628099
  CDS Start-End: 1-1751

SEQ ID NO: 110598 - DNA, 4997 bp, Homo sapiens; identical to SEQ ID NO: 110590
  Payload ID: 1689
  Gene Symbol: BDP1
  Gene Name: B double prime 1, subunit of RNA polymerase III transcription initiation factor IIIB
  ENST ID: ENST00000627715
  CDS Start-End: 1-1821

SEQ ID NO: 110599 - DNA, 120 bp, Homo sapiens
  Payload ID: 1690
  Gene Symbol:
  Gene Name: B melanoma antigen family, member 5 [Source:EntrezGene
  Acc:85316]
  ENST ID: ENST00000624155
  CDS Start-End: 1-120
atggcagccggagcggtttttctggcattgtctgcccagctgctccaagccagactgatgaaggaggagtccccagtggtgagctggaggttggagcctgaagatggcacagctctgtga

SEQ ID NO: 110600 - DNA, 908 bp, Homo sapiens
  Payload ID: 1691
  Gene Symbol: B9D1
  Gene Name: B9 protein domain 1
  Uniprot ID: Q9UPM9
  ENST ID: ENST00000261499
  CDS Start-End: 145-759
cgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagccta

SEQ ID NO: 110601 - DNA, 755 bp, Homo sapiens
  Payload ID: 1691
  Gene Symbol: B9D1
  Gene Name: B9 protein domain 1
  Uniprot ID: Q9UPM9
  ENST ID: ENST00000268841
  CDS Start-End: 101-562
gtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagtttgtgcctggtcgcctcctcagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagaggatata

SEQ ID NO: 110602 - DNA, 805 bp, Homo sapiens
  Payload ID: 1691
  Gene Symbol: B9D1
  Gene Name: B9 protein domain 1
  ENST ID: ENST00000395615
  CDS Start-End: 8-493
acctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagcccagcctggctgatgctgcccttctgtccccagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagccta

SEQ ID NO: 110603 - DNA, 733 bp, Homo sapiens
  Payload ID: 1691
  Gene Symbol: B9D1
  Gene Name: B9 protein domain 1
  ENST ID: ENST00000395616
  CDS Start-End: 165-728
ctgcgcctgcgcatgccacacgcgcactcgcgtggccttcgcgaaggtgtcgctgccaagaaacgtgtcctgcgcgctacgccgtctgtttctagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagatgagaacgctgaggctgagattcccagatcaacctgggtctctctctgccccagcccagcctggctgatgctgcccttctgtccccagtgacccgt

SEQ ID NO: 110604 - DNA, 601 bp, Homo sapiens
  Payload ID: 1691
  Gene Symbol: B9D1
  Gene Name: B9 protein domain 1
  ENST ID: ENST00000440841
  CDS Start-End: 1-402
ctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagatctgcaagctgctccacccactgaggacaaatagaaacaggtcccctgggagtgctgagtcacggggctcccttcagccctgttccagcagcagaaggccgggcgattttaccctgtgccctgtgaaaaatctttgtgtctgagggagcagaggaaaaactcttgtcagatgggaaaaatgctcatgacataatgtgacattaaaaggtgggaaacaagagga

SEQ ID NO: 110605 - DNA, 923 bp, Homo sapiens
  Payload ID: 1691
  Gene Symbol: B9D1
  Gene Name: B9 protein domain 1
  ENST ID: ENST00000461069
  CDS Start-End: 46-606
ccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagctatcacagctccccggaaagctgtcttctctgtccatggcctcacctcacccagggcactggccttggtccacatcaaggggacctgaagcttccctgaagcctctagcctgtggtgtgcacgtacaagcctcaggccccatttgtccagcctgtcagcagctgggaaatactaagtcaccctcttctggttatgtttaattttccaatttttctcaacattactgaaatgtctaaatgtggaaaagttgacatcattttacagtgaacaccacatacccaccacctagattttaccattaccaatttcctgttccgtacttgtatattcacatatatccaactattcatccctgcttcaatccatcctatttttattgcatttcaaaataaactgtgaaatcag

SEQ ID NO: 110606 - DNA, 553 bp, Homo sapiens
  Payload ID: 1691
  Gene Symbol: B9D1
  Gene Name: B9 protein domain 1
  ENST ID: ENST00000575478
  CDS Start-End: 133-553
atgccacacgcgcactcgcgtggccttcgcgaaggtgtcgctgccaagaaacgtgtcctgcgcgctacgccgtctgtttctagggcaacgccggcgtctcttagcaaccgcgcgcggcctagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaaggtaaagctccctcccctctctt

SEQ ID NO: 110607 - DNA, 928 bp, Homo sapiens
  Payload ID: 1691
  Gene Symbol: B9D1
  Gene Name: B9 protein domain 1
  ENST ID: ENST00000575403
  CDS Start-End: 335-778
aacctcatccggccaatcacagctagtcccgtgagctcggggaactgcccggcctgagatgcccaggtctgggactgttaccttggctactggctcccgaagtccccttccgcccagggaattgtgtccgccatttgcttggtcccaggagctctgggaatgtgtcatccccggtagagggtgcccgtcacggccaaccacagagatcccggtcctccgggattctagagcgtccggccgaaccctccactgacttccggtggctgagcctctccgcagcttccggccaagttggactgcagctcgcggtttcctggcttctagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaagccaccttcagggctgtctgtcaaagatagcagtgtttcaagatgaaagcggcttgagtccctgagtcactgacttctgtgagaaacttccgcgggaagccgctgagacctggagatgtgttactgcagcgtaaccaagagcatcccacacacccttctttctctcctgtcccctgcactgaacgggcaccccctg

SEQ ID NO: 110608 - DNA, 1353 bp, Homo sapiens
  Payload ID: 1691
  Gene Symbol: B9D1
  Gene Name: B9 protein domain 1
  ENST ID: ENST00000477478
  CDS Start-End: 335-976
aacctcatccggccaatcacagctagtcccgtgagctcggggaactgcccggcctgagatgcccaggtctgggactgttaccttggctactggctcccgaagtccccttccgcccagggaattgtgtccgccatttgcttggtcccaggagctctgggaatgtgtcatccccggtagagggtgcccgtcacggccaaccacagagatcccggtcctccgggattctagagcgtccggccgaaccctccactgacttccggtggctgagcctctccgcagcttccggccaagttggactgcagctcgcggtttcctggcttctagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcagaagtttacaagctggttcatggggcggcggcccgagtacacagaccccaaggtggtggctcagggtgaaggccgggaaggtaaagctccctcccctctcttacccccatcccccatacaggttacagcctgggagtgggtgggcccagggttggggtgaatgccggggacctgccaggcacataggagctagcccacaaatgttcccagatgagggcctggttggagcacagagggtttgtcatgtctgcctgtcccggcagcccctttacctcccagtgaggggcttgggtcaggcactgttgtccccattttacagatgagaacgctgaggctgagattcccagatcaacctgggtctctctctgccccagcccagcctggctgatgctgcccttctgtccccagtgacccgtgtccgttctcagggctttgtcaccctcctcttcaacgtggtgaccaaggacatgaggaaactgggctatgacactgggccttctgatacacagggtgtgttggggcccagcccaccccagagcttcccccagtgaaggctccacaggctgcacagtctctgataatgaagggctgccttcccgaagtcagccgctgcccatcggcctgaggggcagcctggtggccagagctgggggcacacagaatagttttgtataataaagtctcattttcagagagccta

SEQ ID NO: 110609 - DNA, 496 bp, Homo sapiens
  Payload ID: 1691
  Gene Symbol: B9D1
  Gene Name: B9 protein domain 1
  ENST ID: ENST00000574508
  CDS Start-End: 177-496
atctagtggctgaatgtattttaaacactcggcttgctgagggcgtgagtcggagcgctgctccccaggactcagctctcattcgcctctgcgcttcggcggggacggggagccgggccgagtcagagtgaacacacactccctgcgcgtgcaactgagtcgagcgtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgtctaaactgcag

SEQ ID NO: 110610 - DNA, 495 bp, Homo sapiens
  Payload ID: 1691
  Gene Symbol: B9D1
  Gene Name: B9 protein domain 1
  ENST ID: ENST00000582857
  CDS Start-End: 1-339
agcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgctttgtgtacggccaggactgggcccccacagcgggtctggaggaggggatctcacagatcacatccaagagccaagatgtgcggcaagcactggtgtggaacttccccattgatgtcacctttaaaagcaccaacccctacggctgctgtgcagctggccttctggaagttcagagtgcatcagggctagtggccacgcctgtaaaagggccacagatcgtgctcagcgtgtatggaccagatgtgttcgggaacgatgtggttcgaggctatggggccgtgcacgtgcccttctcacctggccggcacaaaaggaccatccccatgtttgtcccagaatctacgt

SEQ ID NO: 110611 - DNA, 295 bp, Homo sapiens
  Payload ID: 1691
  Gene Symbol: B9D1
  Gene Name: B9 protein domain 1
  ENST ID: ENST00000487415
  CDS Start-End: 238-295
tggactgcagctcgcggtttcctggcttctaggggcacctgacacaaggtctggcccttcacccacactgcagcagccgcccttgttaacgctgtccccgctccgcccagtccctgcggtgttccagcagcatcttcagtgtgggtattgcaggcaccaatggaacaggttggggaggagagtttgggaccaagaacacccatgaacccttagaagccaccatagagtttccagagtatgatgacctctactgcaagtactgctttgtgtacggccaggactgggcccccacagc

SEQ ID NO: 110612 - DNA, 1027 bp, Homo sapiens
  Payload ID: 1692
  Gene Symbol: B9D2
  Gene Name: B9 protein domain 2
  Uniprot ID: Q9BPU9
  ENST ID: ENST00000243578
  CDS Start-End: 221-748
aggggaggagcctgctgttgccccagcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcataggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattctta

SEQ ID NO: 110613 - DNA, 848 bp, Homo sapiens
  Payload ID: 1692
  Gene Symbol: B9D2
  Gene Name: B9 protein domain 2
  ENST ID: ENST00000594416
  CDS Start-End: 213-461
agcctgctgttgccccagcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcataggggccagcggtttctcggaaagtagcctcttctgcaagtggggcattcacacagagacagggtctcgctatgttgcccaggctggtctcgaactcctgcgctcaaacaggccacccacttcagcctctcaaagtgctaggattaaaaacgggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctc

SEQ ID NO: 110614 - DNA, 1874 bp, Homo sapiens
  Payload ID: 1693
  Gene Symbol: BPI
  Gene Name: bactericidal/permeability-increasing protein
  Uniprot ID: P17213
  ENST ID: ENST00000262865
  CDS Start-End: 90-1553
acattctactgacttgcatttccccagccgactcttttatagctccctggttcaacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtggggtggctgatccaactcttccacaaaaaaattgagtctgcgcttcgaaacaagatgaacagccaggtctgcgagaaagtgaccaattctgtatcctccgagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccacacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtgga

SEQ ID NO: 110615 - DNA, 2857 bp, Homo sapiens
  Payload ID: 1693
  Gene Symbol: BPI
  Gene Name: bactericidal/permeability-increasing protein
  ENST ID: ENST00000451435
  CDS Start-End: 112-399
aaaaccaccccgtttcagccctcagcctcagggctgagattcaggctcaggtctaggggttggggaatattaaagtttacaagtacaatcttactccatccatacacacacatggagaagccaggagaggacgcggccagagatgggctcctgcccttgaacccctgctggggtggaagcagagatgggggctccctatgttgcccaggctggtctcaaactcctggacccaagccatcctcccaaagtgctgggattacaagtgtgagccaccacgccaagcctgactttaagatttttgccaatccagtggacaagacaggagactggaagaaggggccagaaattcagactcagaagccccctccagaggccacaaggcagcctggtcctctctgaaccagtggctcccactcactggccccttgtctctgcctggactcctgcggatgagtggaaggccaagagggcgccctctggtgcccactagatcgactcccaattaatcacttaactgtgtgaccctgggccaactactcaacctctctgtgcctcgggtcctcctctgaacatggggataaagacagtgcttgcctcgtggggatgttgtgtgtgtatacatgcatacacacgtgtgcaaagagcttagagccacgcctggtaccatttacatgctcagtaaatgtttaggaggattgttgtgataacccagcagactgatgtgtaagcctatggtcccatctcagggcatgtgggtgtcacaggatcgtagtcctaacagcccaaaaataatgttaaaatgactcaaggacttcacttatgcttctgagcatcctgaaggaaataggcacagtctacagaactacttcctaatgctccccttagttcaactgtccacttcctcagcacagtccctgtatgtctttggaggtcccccttctccagacctccttcattcagccaacagcgtttattgagcacctgctctgtgccagccagctgctgttctaggctcttagaataaatcagaaaaccaaatagatgaaaaattctcattgttcacaagtagattctagacgtctccccagagcaaagcccaggcccttggccttcctctcccctgcctctttcttcctcattctgcacccagaacccaagaaaacgctgcagcccttcctgggagggcaggagagaggaaagatctgagttggccaagccaggctctccagcaggcagggctccagcagaggctgggcaccttcagccatcagcaactgtgtcccattacctgtggaaagcaccagccctggcctggaaaacagtaggagttcatcaagagtggctttgttgtacagtggttgtcttgtacccagttggattggcagcagcttcggggcacgaggagcgactgttcactccttggggagcttgcagcacagggcaaggtgcacagtaggcacttggtggctggcagggccctctggggcatcctatgggtgaatatcttgctgagcccatggaaggcccatgtcagaatccagtaatgtgctggggaggcgagctggggtggggttggaagtggtgctcaccagcccagccagggttcctcttaaaagtcacagtgctcgaagccagtacagtgcctcacccctttttatgccctcacctggctcatctcccatccattagtcctcaaggtacatctgtgagtcccatgggtcaggtagtgggtgcaatgggaggagatgagggtgtggacttgtcctcagatctacctcttagtacctatgagaagtcagcaaccaccctgaccctctgtgtcttcatctgtaaaatgcatatattagtctcttctttggtggaaaggattaaatgagatgttgcatatggaggcatgtgagggttttgtaagtgctcattctcccttttgcctcaggaagaaagcctccaccttcagactatcaggcacctggggacagaccccaggacactgccttttgtggctcttgccacccatggtcacctcagttactcaagccacacatgcatgttcgtgcatcccccacatatacacagaaactcacgggcgttatatcaaccagggttcctagctgcaagcaacagaaagcaaccatgactgacttaagcagaaaaggaatttctcaaaagaatattatttgatttatggaatcacaggaaatcatccaggtctctacctggaaggcagaatgaaccttattaaaatcagttgagatgcgcacttagcattgtgccttgcacagagtaactgctcaggaaaggttatccaataataatgaaagcatgtcttatggtgtgacacctctgctcaaaatcctttcatagatccaattgtctaccatggaaacccggcctctgggctgtggatacttgtgatgggagaggtggtgcgggctccgaattctttccaatagtctgcaaacccgcagagccatgaagcattgtctgtaggccagcactcatcctccacccctctgcctgcttctccgctctcctagttccttctccctcctctaggaattcagcattgccactctgattggctggattttgggacattgattgagccttgttttctagtgggcaggaggctctgtgtcttaaaggccactggcccagctgccaatgaatcagtactttgtttccccaggtagagtgggggcagggggcagggaacgggcagggcaagtttggggcattctgctccgaggtccctctagccaaacgttatcaaatctcatccaacatgctcctggctctccatttcagatgtctgtaaactggggactacaaaatgcaaatatgtttaagagttgct

SEQ ID NO: 110616 - DNA, 507 bp, Homo sapiens
  Payload ID: 1693
  Gene Symbol: BPI
  Gene Name: bactericidal/permeability-increasing protein
  ENST ID: ENST00000418004
  CDS Start-End: 138-507
cacagtcagttccaaaacaaacatgcaaaaccaccccgtttcagccctcagcctcagggctgagattcaggctcaggtctaggggttggggaatattaaagtttacaagtacaatcttactccatccatacacacacatggagaagccaggagaggacgcggccagagatgggctcctgcccttgaacccctgctggggtggaagcagagatgggggctccctatgttgcccaggctggtctcaaactcctggacccaagccatcctcccaaagtgctgggattacaagtgtgagccaccacgccaagcctgactttaagatttttgccaatccagtggctccctggttcaacctcaaggccttgaggttttggcagctctggaggatgagagagaacatggccaggggcccttgcaacgcgccgagatgggcgtccctgatggtgctggtcgccataggcaccgccgtgacagcggccgtcaaccctggcgtcgtggtcaggatct

SEQ ID NO: 110617 - DNA, 1082 bp, Homo sapiens
  Payload ID: 1693
  Gene Symbol: BPI
  Gene Name: bactericidal/permeability-increasing protein
  ENST ID: ENST00000417318
  CDS Start-End: 81-941
cccagattctagtggcaagttcacagactccatctcttggtgggggtgtggcaaagccacattacagaagagcaaatggaatggaaaatgtctgcgagaaagtgaccaattctgtatcctccgagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccacacctgttcctgatgggctgtggggcaccggctgcctttccccagggaatcctctccagatcttaaccaagagccccttgcaaacttcttcgactcagattcagaaatga

SEQ ID NO: 110618 - DNA, 794 bp, Homo sapiens
  Payload ID: 1693
  Gene Symbol: BPI
  Gene Name: bactericidal/permeability-increasing protein
  ENST ID: ENST00000489102
  CDS Start-End: 58-225
cagactccatctcttggtgggggtgtggcaaagccacattacagaagagcaaatggaatggaaaatgtctgcgagaaagtgaccaattctgtatcctccgagctgcaaccttatttccagactctgccagtaatgaccaaaatagattctgtggctggaatcaactatggtctggtggcacctccagcaaccacggctgagaccctggatgtacagatgaagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtc

SEQ ID NO: 110619 - DNA, 383 bp, Homo sapiens
  Payload ID: 1693
  Gene Symbol: BPI
  Gene Name: bactericidal/permeability-increasing protein
  ENST ID: ENST00000479646
  CDS Start-End: 81-170
ggctgagattcaggctcaggtctaggggttggggaatattaaagtttacaagtacaatcttactccatccatacacacacatggagaagccaggagaggacgcggccagagatgggctcctgcccttgaacccctgctggggtggaagcaggtgcacaatgcttctttgagtatctccgtgtctgtggctgatatccagatgcaaggcttcttccgggcatccctgggaatgggagtgcatagacatactggtcaaattacagcacagcctctacacctttactgaagatggaaaactgttttccaaagttgacttgcctaacatgatgtaactatcatgcaaaaataaaaataaaattaagaataaaaatttaaaaatgaaa

SEQ ID NO: 110620 - DNA, 3743 bp, Homo sapiens
  Payload ID: 1694
  Gene Symbol: BIRC2
  Gene Name: baculoviral IAP repeat containing 2
  Uniprot ID: Q13490
  ENST ID: ENST00000227758
  CDS Start-End: 1400-3256
ggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaaga

SEQ ID NO: 110621 - DNA, 1927 bp, Homo sapiens
  Payload ID: 1694
  Gene Symbol: BIRC2
  Gene Name: baculoviral IAP repeat containing 2
  Uniprot ID: Q13490
  ENST ID: ENST00000530675
  CDS Start-End: 165-1874
atcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttg

SEQ ID NO: 110622 - DNA, 505 bp, Homo sapiens
  Payload ID: 1694
  Gene Symbol: BIRC2
  Gene Name: baculoviral IAP repeat containing 2
  ENST ID: ENST00000532832
  CDS Start-End: 269-505
atcgtgcgtcagagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatg

SEQ ID NO: 110623 - DNA, 720 bp, Homo sapiens
  Payload ID: 1694
  Gene Symbol: BIRC2
  Gene Name: baculoviral IAP repeat containing 2
  ENST ID: ENST00000533742
  CDS Start-End: 173-720
agagtgagcccggatggggcggcgggcttcgggagcgcccgggctgatccgagccgagcgggccgtatctccttgtcggcgccgctgattcccggctctgcggaggcctctaggcagccgcgcagcttccgtgtttgctgcgcccgcactgcggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggc

SEQ ID NO: 110624 - DNA, 866 bp, Homo sapiens
  Payload ID: 1694
  Gene Symbol: BIRC2
  Gene Name: baculoviral IAP repeat containing 2
  ENST ID: ENST00000528344
  CDS Start-End: 1-789
tatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtgtgagttcttgatacgaatgaaaggccaagagtttgttgatgagattcaaggtagatatcctcatcttcttgaacagctgttgtcaact

SEQ ID NO: 110625 - DNA, 595 bp, Homo sapiens
  Payload ID: 1694
  Gene Symbol: BIRC2
  Gene Name: baculoviral IAP repeat containing 2
  ENST ID: ENST00000527465
  CDS Start-End: 149-595
gatccgagccgagcgggccgtatctccttgtcggcgccgctgattcccggctctgcggaggcctctaggcagccgcgcagcttccgtgtttgctgcgcccgcactgcgacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctct

SEQ ID NO: 110626 - DNA, 2617 bp, Homo sapiens
  Payload ID: 1694
  Gene Symbol: BIRC2
  Gene Name: baculoviral IAP repeat containing 2
  ENST ID: ENST00000532672
  CDS Start-End: 338-2131
gggcttcgggagcgcccgggctgatccgagccgagcgggccgtatctccttgtcggcgccgctgattcccggctctgcggaggcctctaggcagccgcgcagcttccgtgtttgctgcgcccgcactgcgatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgctttaaaaag

SEQ ID NO: 110627 - DNA, 572 bp, Homo sapiens
  Payload ID: 1694
  Gene Symbol: BIRC2
  Gene Name: baculoviral IAP repeat containing 2
  ENST ID: ENST00000531259
  CDS Start-End: 154-572
cgggagcgcccgggctgatccgagccgagcgggccgtatctccttgtcggcgccgctgattcccggctctgcggaggcctctaggcagccgcgcagcttccgtgtttgctgcgcccgcactgcgatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttg

SEQ ID NO: 110628 - DNA, 4066 bp, Homo sapiens
  Payload ID: 1694
  Gene Symbol: BIRC2
  Gene Name: baculoviral IAP repeat containing 2
  Uniprot ID: Q13490
  ENST ID: ENST00000613397
  CDS Start-End: 1730-3586
gcggtgagtgctgctccttccgggctcgggcggcgtggggcgggtggggacgcgagggcccgcgggggcccacttccctgatgtggcggcgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccactcttctggcccttggactttgaccaagatgttttctcgcagtttttgcaaggttttaaacttagccctcggcgttcttttaatgtaatacattgaaacgaagatatttcggtggcggcgatatttcatatttcatagttgccactgcgctctgtcattccagtagtcgtctgttgtgtattgtgagaagcaactctgggaaattattggatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttt

SEQ ID NO: 110629 - DNA, 3331 bp, Homo sapiens
  Payload ID: 1694
  Gene Symbol: BIRC2
  Gene Name: baculoviral IAP repeat containing 2
  ENST ID: ENST00000621637
  CDS Start-End: 1730-3331
gcggtgagtgctgctccttccgggctcgggcggcgtggggcgggtggggacgcgagggcccgcgggggcccacttccctgatgtggcggcgaacgaggaaggacggggcctgaggcccttcggccaagggtcgagggtcgccgggggctctctgctttctactctcgccaaggttttattggattcggaagccccaacttcgagacttgcagtcaaagcgatttttaaaatgacttgttttcaagcctctggccgccgcccactcttctggcccttggactttgaccaagatgttttctcgcagtttttgcaaggttttaaacttagccctcggcgttcttttaatgtaatacattgaaacgaagatatttcggtggcggcgatatttcatatttcatagttgccactgcgctctgtcattccagtagtcgtctgttgtgtattgtgagaagcaactctgggaaattattggatttacaaccctgaagaatctccctatccctattttgtccccctgcagtaataaatcccattatggagatctcgaaactttataaagggatatagtttgaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggtaattcagagagatactcatcctacctgaatataaactgagataaatccagtaaagaaagtgtagtaaattctacataagagtctatcattgatttctttttgtggtaaaaatcttagttcatgtgaagaaatttcatgtgaatgttttagctatcaaacagtactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttcttaatgctgaagatgaaaaaagagaagaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagtaaaacaaagattt

SEQ ID NO: 110630 - DNA, 5197 bp, Homo sapiens
  Payload ID: 1695
  Gene Symbol: BIRC3
  Gene Name: baculoviral IAP repeat containing 3
  Uniprot ID: Q13489
  ENST ID: ENST00000263464
  CDS Start-End: 2751-4565
ggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaacatctcaaaatggagacctaaaatccttaaagggacttagtctaatctcgggaggtagttttgtgcatgggtaaacaaattaagtattaactggtgttttactatccaaagaatgctaattttataaacatgatcgagttatataaggtataccataatgagtttgattttgaatttgatttgtggaaataaaggaaaagtgattctagctggggcatattgttaaagcatttttttcagagttggccaggcagtctcctactggcacattctcccattatgtagaatagaaatagtacctgtgtttgggaaagattttaaaatgagtgacagttatttggaacaaagagctaataatcaatccactgcaaattaaagaaacatgcagatgaaagttttgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccaaaagtttgtttaaatgggctgttaccgctgagaatgatgaggatgagaatgatggttgaaggttacattttaggaaatgaagaaacttagaaaattaatataaagacagtgatgaatacaaagaagatttttataacaatgtgtaaaatttttggccagggaaaggaatattgaagttagatacaattacttacctttgagggaaataattgttggtaatgagatgtgatgtttctcctgccacctggaaacaaagcattgaagtctgcagttgaaaagcccaacgtctgtgagatccaggaaaccatgcttgcaaaccactggtaaaaaaaaaaaaaaaaaaaaaaaaaagccacagtgacttgcttattggtcattgctagtattatcgactcagaacctctttactaatggctagtaaatcataattgagaaattctgaattttgacaaggtctctgctgttgaaatggtaaatttattattttttttgtcatgataaattctggttcaaggtatgctatccatgaaataatttctgaccaaaactaaattgatgcaatttgattatccatcttagcctacagatggcatctggtaacttttgactgttttaaaaaataaatccactatcagagtagatttgatgttggcttcagaaacatttagaaaaacaaaagttcaaaaatgttttcaggaggtgataagttgaataactctacaatgttagttctttgagggggacaaaaaatttaaaatctttgaaaggtcttattttacagccatatctaaattatcttaagaaaatttttaacaaagggaatgaaatatatatcatgattctgtttttccaaaagtaacctgaatatagcaatgaagttcagttttgttattggtagtttgggcagagtctctttttgcagcacctgttgtctaccataattacagaggacatttccatgttctagccaagtatactattagaataaaaaaacttaacattgagttgcttcaacagcatgaaactgagtccaaaagaccaaatgaacaaacacattaatctctgattatttattttaaatagaatatttaattgtgtaagatctaatagtatcattatacttaagcaatcatattcctgatgatctatgggaaataactattatttaattaatattgaaaccaggttttaagatgtgttagccagtcctgttactagtaaatctctttatttggagagaaattttagattgttttgttctccttattagaaggattgtagaaagaaaaaaatgactaattggagaaaaattggggatatatcatatttcactgaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactctta

SEQ ID NO: 110631 - DNA, 549 bp, Homo sapiens
  Payload ID: 1695
  Gene Symbol: BIRC3
  Gene Name: baculoviral IAP repeat containing 3
  ENST ID: ENST00000527309
  CDS Start-End: 1-549
cagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaagatggagcctggctctgttgcccagattggagtgcgatggtgtgatgtcagctcactgcaacctccgcctcttgggttcaggcaattctcatgcctcgagcctcgctagtagctgggattacaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatact

SEQ ID NO: 110632 - DNA, 4238 bp, Homo sapiens
  Payload ID: 1695
  Gene Symbol: BIRC3
  Gene Name: baculoviral IAP repeat containing 3
  Uniprot ID: Q13489
  ENST ID: ENST00000532808
  CDS Start-End: 123-1937
gggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccatagataataa

SEQ ID NO: 110633 - DNA, 4342 bp, Homo sapiens
  Payload ID: 1695
  Gene Symbol: BIRC3
  Gene Name: baculoviral IAP repeat containing 3
  Uniprot ID: Q13489
  ENST ID: ENST00000615299
  CDS Start-End: 236-2050
gcatttaaaagacagcgtgagactcgcgccctccggcacggaaaaggccaggcgacaggtgtcgcttgaaaagactgggcttgtccttgctggtgcatgcgtcgtcggcctctgggcagcaggtttacaaaggaggaaaacgacttcttctagatttttttttcagtttcttctataaatcaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggttcctgtctcagaaaggagtcttgctcgtgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcgtctaaactttagaattaatttattaaatgtattataactttaacttttatcctaatttggtttccttaaaatttttatttatttacaactcaaaaaacattgttttgtgtaacatatttatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaagcaacaaaaattactcttattcttcattgctttatttcaatgacattggatagtttagtcactcccagactctttccataccttcttaaagcctctcaaatattgaactacagtttatactccttcccataagatgcttcttcattgacacttgtagaacacggggtcaacacatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacaggttgttctggtaaataaatctgtttcatattgtcagtgcaacaaaatgtccccctctgcattatgttattggtactcaacacgtccgagtcataactctgtcctttgcttcttatagaggtattaggtcttcaagagcagaagtaagactgtaatagggaatactcaggggaaggcaggcaaaggctagtcatctaaaccagttctagatgtctgtataggggcagatggctctgtaagggcagaagggaaagaccccttcataagggtcacagctgacaatcctataacaaaagacaggttaacaagagaaaaacttaacaaatttatttaatcacagatttacatcaccggggagccttcgtaatgaagatccaaaattacaggggaaactgtgcatttttatgcttaggtttgataatgaatggacagccctgaagaatagtgattggaaaaaaaggatatgatctaatgggaatagacacaggttggggacccagcaaggcctgtctgttcagattattcttggtctctgtgcagcattccttcctcctggatatagggcagggcctgtatgggatggggatattataacctgctatcaagcaaggtaggtcagagaatttatttatggccagctcttacatagttaggtgaggaaagattagagtactatctttaagatgtaagtctggcattgtggaaagatggttccagtttctatgacctaccttggggaagaggaattcaagtttctgtggcttgccttcagggagaatgaggctgagacaggagggcaggataacatcagagaaaaactttgcttctgaggccttcactttgggttttctgagccccaacatctgctagtgttgtaaagagaacaattagggaccaagtgaggggaggaaagaatccatctctgcattctgatgctgggagacttatttccttgaaatgcaattgattttgcctctgctaagaggctctgctggctacccatgtactagccagtgtcctgcatgggtgctaggctgaattatttgtaattgtgcttaggtgatttgtaactcaggtatagggtatttaaatagtaggcaccctttttgcaccatgtgtttttttttttatctagttcttgtatactacagataatatttgaactttgtcatctcactgtaaaacttttgttcatttctcattatggtaataaatagctattataaccaacccatttattcaaatatgttatttccctaagtgttattttgacattttgttttggaaaaaataaatcaccat

SEQ ID NO: 110634 - DNA, 2711 bp, Homo sapiens
  Payload ID: 1696
  Gene Symbol: BIRC5
  Gene Name: baculoviral IAP repeat containing 5
  ENST ID: ENST00000301633
  CDS Start-End: 132-629
cgcctctactcccagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctac

SEQ ID NO: 110635 - DNA, 2630 bp, Homo sapiens
  Payload ID: 1696
  Gene Symbol: BIRC5
  Gene Name: baculoviral IAP repeat containing 5
  ENST ID: ENST00000350051
  CDS Start-End: 120-548
cagaaggccgcggggggtggaccgcctaagagggcgtgcgctcccgacatgccccgcggcgcgccattaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctac

SEQ ID NO: 110636 - DNA, 2446 bp, Homo sapiens
  Payload ID: 1696
  Gene Symbol: BIRC5
  Gene Name: baculoviral IAP repeat containing 5
  Uniprot ID: O15392
  ENST ID: ENST00000374948
  CDS Start-End: 54-467
ttaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgcaaaggaaaccaacaataagaagaaagaatttgaggaaactgcggagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcttgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagccgcccctctcagcccgcctgccacggcctttccttaaaggccatccttaaaaccagaccctcatggctaccagcacctgaaagcttcctcgacatctgttaataaagccgtaggcccttgtctaagtgcaaccgcctagactttctttcagatacatgtccacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctac

SEQ ID NO: 110637 - DNA, 568 bp, Homo sapiens
  Payload ID: 1696
  Gene Symbol: BIRC5
  Gene Name: baculoviral IAP repeat containing 5
  Uniprot ID: O15392
  ENST ID: ENST00000590449
  CDS Start-End: 38-262
aatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaacgtccaagtgctttttttgagatttt

SEQ ID NO: 110638 - DNA, 524 bp, Homo sapiens
  Payload ID: 1696
  Gene Symbol: BIRC5
  Gene Name: baculoviral IAP repeat containing 5
  ENST ID: ENST00000586192
  CDS Start-End: 1-250
gaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgaggtcaggagatcgagaccatcttggctaatacgagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggag

SEQ ID NO: 110639 - DNA, 386 bp, Homo sapiens
  Payload ID: 1696
  Gene Symbol: BIRC5
  Gene Name: baculoviral IAP repeat containing 5
  Uniprot ID: O15392
  ENST ID: ENST00000592734
  CDS Start-End: 1-237
atgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaag

SEQ ID NO: 110640 - DNA, 492 bp, Homo sapiens
  Payload ID: 1696
  Gene Symbol: BIRC5
  Gene Name: baculoviral IAP repeat containing 5
  ENST ID: ENST00000587746
  CDS Start-End: 1-364
gaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccattgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggag

SEQ ID NO: 110641 - DNA, 496 bp, Homo sapiens
  Payload ID: 1696
  Gene Symbol: BIRC5
  Gene Name: baculoviral IAP repeat containing 5
  ENST ID: ENST00000591800
  CDS Start-End: 1-157
gaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatgtaatgggccgggcacggtggcttacgcctgtaataccagcactttgggaggccgaggcgggcggatcacgagagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggag

SEQ ID NO: 110642 - DNA, 648 bp, Homo sapiens
  Payload ID: 1696
  Gene Symbol: BIRC5
  Gene Name: baculoviral IAP repeat containing 5
  Uniprot ID: O15392
  ENST ID: ENST00000590925
  CDS Start-End: 55-417
attaaccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggcaaaggaaaccaacaataagaagaaagaatttgaggaaactgcggagaaagtgcgccgtgccatcgagcagctggctgccatggattga

SEQ ID NO: 110643 - DNA, 508 bp, Homo sapiens
  Payload ID: 1697
  Gene Symbol: BIRC6
  Gene Name: baculoviral IAP repeat containing 6
  ENST ID: ENST00000431454
  CDS Start-End: 1-331
ggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacat

SEQ ID NO: 110644 - DNA, 15703 bp, Homo sapiens
  Payload ID: 1697
  Gene Symbol: BIRC6
  Gene Name: baculoviral IAP repeat containing 6
  Uniprot ID: Q9NR09
  ENST ID: ENST00000421745
  CDS Start-End: 135-14708
tccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtgctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggcacagcagctcttatcagcatgtttagaaaaggtagatatttctagtacagagggttatgatttgttcatcacacagctcaaagatggtttaaaaaatacatctcatgagactgcagcaaaccacaaagttgctaagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacagatcactgatgtatagtgaagctaacagacgggagacatttacctcatggcctcatgtaggctataggtgggcacaaccagatcccatggctcaagctggattttatcatcagcctgcctcatctggagatgatagagccatgtgttttacttgtagtgtatgcctcgtttgttgggaacctactgatgaaccttggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagatagtgatgatttactggaggattcagacagtgaagagcattccagatcagattctgtgacagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatgctcttaacattgaagtggaacaaaatgggaaaccgtccctggttgatttgaatgaagaaatgcagcacatggatgtagaggaatcacagtgtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaagagtgcaacgatgtgccatgttacagttttcagaatttcatgagaagcttcttaatactctttgcagaaaaacagatgatggccagatcacagaacatgcccagagccttgtgttggatactctctgttggttagctggagttcattcaaatggacccggaagctcaaaggaaggaaatgagaacctactttcaaaaacacgaaaatttctgtcagacatcgtacgtgtttgcttctttgaggcaggacgaagtatagcccataagtgtgcccgatttctagccttgtgcattagtaatggcaaatgtgacccatgtcaaccagcatttggacctgttctgttgaaggctttacttgataatatgtcatttttacctgcagcaacaactggtggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaagatatggattatatagctcaccatttgatccagtcctctttgatttggagatgagtggctcttcttgtaaaaatgtttataacagcagcattggtgtccagtcagatgaaattgatttatcagatgtcctttcaggaaatggaaaggtcagtagttgcacagctgctgagggtagtttcacatctctcactggacttttggaagttgaacctctgcactttacttgtgtgtcaactagtgatggaaccagaatagaaagggatgatgcaatgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatgaatccacttggttctggtctagcccttgcaatttctcatgcttcacattttcttcaacctccgcctcaccagtccattattatagagcgaatgcattcaggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggatagggtcttcatgttactttcctgcattggtcaaagatcacttagtaatagtggagtattagaaagcttacttaatctcttggataatttattgtcacctcttcagccacagttacccatgcataggaggacagaaggagtactagatattcccatgatcagttgggttgttatgctggtgtccaggttgctggattatgtggcaactgttgaagatgaagcagcagctgcaaagaaacctttgaatggtaatcagtggagttttattaacaataatctacacactcagagcttaaatagatcttctaaaggcagcagtagccttgatagattatattccagaaaaatcagaaagcagcttgttcatcataaacagcaacttaacctactaaaagcaaagcagaaggcattggtagaacagatggaaaaagaaaaaatacaaagtaacaaaggatcatcatataaactcctggtagaacaagcaaaactaaagcaggccacttcaaagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtgcacctcctctgtcctctttggaaaaagataaagaaattgaccttgagttacttcaggatctaatggaagttgacattgatcctttagatattgatttggaaaaggaccctcttgcagccaaggtttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcaggccctggatgctcgcctagaagttggacttgaacagcaagcagaactgatgttgaaaatgatgtctactctggaggcagattccattttacaggcattaacaaatacatctcctacattatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcagttggagtcacttctccaattgtggctcacactgagcctgaattctagttcaactggaaacaaagaaaatggagcagacatatttttatataatgctaataggatacctgttatttcattaaatcaagcatcaataactagctttctcacagtgttagcttggtatcccaatactttgctccggacatggtgccttgtgcttcatagcctaacactcatgacaaacatgcagcttaattctggttccagcagtgccattggaactcaggagagtactgctcatttgttggtttcagatccaaacctaattcatgtattagtgaaatttctttctggcaccagtccacatggaacaaatcaacacagtccacaggttggtcctacagctacacaagctatgcaagaatttcttactcgattacaagtgcatctttcttcaacatgtcctcagatattcagtgaatttttgctcaagctaattcatatactttcaactgaaaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaaggctctcttgctacttgccagttatctgagccattattgtggttcattttgagagtattggatactagtgatgccttgaaagcatttcatgatatgggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaacctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacagatttgaatagtcctttactttttggaagactaaatggactctcttctgactctacgatagatattctttaccagcttggaacaactcaggatcctggtacaaaagacagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggttctttgtgaactatttcagacatctcctcaaagagggaaccttccaacatctgggaacatttcagggtttatacgaagattatttttacagttgatgctggaagatgagaaagtgacaatgtttcttcagtctccatgtccactgtacaaaggtagaattaatgctactagccacgtcatccagcatccaatgtatggagcaggccacaaattccgtactcttcatttgccagtctcaacaacattatcagatgttcttgacagagtgtcagatactccaagtatcacagctaaattaattagtgaacaaaaagatgacaaagaaaagaaaaaccatgaagagaaagaaaaagttaaagcggaaaatggatttcaagacaattacagtgttgttgttgcctctgggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcaggaaaaaaaactgggtgaatactccaagaaggcggctatgaaacccaaacctttgtcagtattaaagtcacttgaagaaaaatatgtggctgttatgaagaaattacagtttgatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtttgtttaagcatcttaaacacgtggcatggaagaccagaagagaagtggaatcctcagacctcaagctttttgcaagtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtaatacacaaacatttttacttgaaaagagttgagataatggcccaatgtgaggagtggattgcggatatccagcagtacagcagtgataagcgggtaggcaggactatgtctcaccatgcagcagctctcaagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaa

SEQ ID NO: 110645 - DNA, 575 bp, Homo sapiens
  Payload ID: 1697
  Gene Symbol: BIRC6
  Gene Name: baculoviral IAP repeat containing 6
  ENST ID: ENST00000444173
  CDS Start-End: 1-575
agctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatggtcttagattatgtccatttttggaggatcataaagaagacattctatgtgggccagtatggcttgctagtggccttgatctatcagggcatgctggaatgttgacgttaacaagccccaaacttgttaaaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggaaaaatcatctaatgttaagaatgaaaatacaagtggcacccgtaaatctgaaaacctccggggctgtgatttacttcaagaggtctcagtcaccattcgaagatt

SEQ ID NO: 110646 - DNA, 1368 bp, Homo sapiens
  Payload ID: 1698
  Gene Symbol: BIRC7
  Gene Name: baculoviral IAP repeat containing 7
  Uniprot ID: Q96CA5
  ENST ID: ENST00000217169
  CDS Start-End: 215-1111
gaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagcagcctg

SEQ ID NO: 110647 - DNA, 1302 bp, Homo sapiens
  Payload ID: 1698
  Gene Symbol: BIRC7
  Gene Name: baculoviral IAP repeat containing 7
  Uniprot ID: Q96CA5
  ENST ID: ENST00000342412
  CDS Start-End: 215-1057
gaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggccatcaggacaaggtgaggtgcttcttctgctatgggggcctgcagagctggaagcgcggggacgacccctggacggagcatgccaagtggttccccagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggta

SEQ ID NO: 110648 - DNA, 593 bp, Homo sapiens
  Payload ID: 1698
  Gene Symbol: BIRC7
  Gene Name: baculoviral IAP repeat containing 7
  ENST ID: ENST00000395306
  CDS Start-End: 7-588
gcagaaatgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggacccgtgggaagaaccggaagacgcagcccctgtggccccctccgtccctgcctctgggtaccctgagctgcccacacccaggagagaggtccagtctgaaagtgcccaggagccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccag

SEQ ID NO: 110649 - DNA, 2026 bp, Homo sapiens
  Payload ID: 1699
  Gene Symbol: BIRC8
  Gene Name: baculoviral IAP repeat containing 8
  Uniprot ID: Q96P09
  ENST ID: ENST00000426466
  CDS Start-End: 1253-1963
caacctacacacgtgtgtgtgcgcgtgtgtataaaacacagtgcactaatactcagcctttaaaaaaaatgccacttgcaacaacgtagatggagctggacgatatcatgctaaaattatgcaaagtgaaacaagcacaaaaaagaacgagacacgggcgtggggcacgaggtgctcactgcgcaagcgcccactccaccgcgtggtttccagctggaggctgggagcgttcgtggcttcctcttttcttgctgacccttcggagctctgggaagtggctgcaccttggcggctccccagagcgcgcggtgctaatcgtgggtcgtcagcctgggtggctgggcccggcttagggcagggtttggcatttccaatggtagggggctcggaccgtccctccgcgggaccctcccgttgggacaaggccgatcgcctgggcggttggagccgctatcctggcgcgagacggtggacaagtcctatattcaagagaagataactttgaacagtttcgaaggatctaaaacgtatgtgtctgcagacatcaatgaggatgaagaattagtagaagagattaatagatcaaaaacgtttgctggctttgcaggtggtgggcctgcctgggcatcggcgcgttggaggagacgccctggggggccttagctgccctgaagcggtagacaggtggcaacgtgggggctcaggagttgacaaacacaagaaagcagcgccgaattgcaggtttatccgcagcttttattttgaagacagtgccacgaaacctgcaaatcctggtgtcccaaatagtcaataccaagttgaaaaccatctgggagaggaaaagcgttgtgctttagacaggccgtctgagactcgtgcagaccggcttttgagagctggacaggtggtggatagatcagactccatacacccgaggagccccgccatgcatagtgaagaagctagataacagtcgtttcacaactggccagcctctgcccacttgaccccgagagagctggccagtgctgggctgtactacacaggcactgatgaccaagtgcagtgcttctgttgtggcggaaaactgaaaaactgggaacctggtgatcgtgcctggtcagaacacaggagacattttcctaattgcttctttattttgggccacaacgttaatattcgaggtgaatctgatgttgcgagttctgataggaatttctcaaattcaacaagttctccaaggaatccatccatgacgggttatgaagcccggctcattacttttgggacatggatgtactccgttaacaaagagcagcttgcaagagctggattttatgctataggtcaagaggataaagtacagtgctttcactgtggaggagggctagccaactggaagcccaaggaagatccttgggaacagcatgctaaatggtatccaggttgcaaatatctgctagaagagaagggacatgaatatataaacaacattcatttaacccgttcacttgagggagctctggtacaaactaccaagaaaacaccatcactaactaaaagaatcagtgataccatcttccctaatcctatgctacaagaagctatacgaatgggatttgatttcaaggacgttaagaaaataatggaggaaagaattcaaacatctgggagcaactataaaacgcttgaggttcttgttgcagatctagtgagcgctcagaaagacactacagaaaatgaattgaatcagacttcattgcagagagaaatcagccctgaagagccgctaaggcgtctgcaagaggagaagctttgtaaaatctgcatggacagacatatcgctgttgtttttattccttgtggacatctggtcacttgtaaacaatgtgctgaagcagttgacagatgtcccatgtgcagcgcggttattgatttcaagcaaagagtttttatgtcttaatgtaactctacagtgggtgtgctatgttcttattaccctgattaaatgtgtgatgtgactcaa

SEQ ID NO: 110650 - DNA, 10342 bp, Homo sapiens
  Payload ID: 1700
  Gene Symbol: BAHCC1
  Gene Name: BAH domain and coiled-coil containing 1
  ENST ID: ENST00000307745
  CDS Start-End: 1-7827
atggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacagccagcagccgcctgatgggaagttctccggcctcctcgttcatgggcagtttcctcaccagcagcctgggctcggcagcctccacgcaccccagcggccccagctcctccccccctgagcaggcctaccgtggctcccaccccaccacctcccagatctggttctcccactcccacgaagctccggggtaccccagattttcggggagtctggcatccaccttcctacccgtgagccacttggatcaccatggaaacagcaacgttctctatgggcagcaccgtttctatggaacccaaaaagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggtt

SEQ ID NO: 110651 - DNA, 10801 bp, Homo sapiens
  Payload ID: 1700
  Gene Symbol: BAHCC1
  Gene Name: BAH domain and coiled-coil containing 1
  ENST ID: ENST00000584436
  CDS Start-End: 368-8287
gagagccgctctggatgggctcgctagagtcgttgttgtggaagcggtgcatttacagtgcaacagtcagcacattgaaaataccaataggaatacaaaacaaagtcacatttactgatttaattgtattgcattcagttgtatccaggaaacagcctccaaccatggacccgcacagcggccgctggctcggtgcgcggccgcccgccgagaagcccagtcctcccgcgtgctgaccggccccgccgccaccaccgcctgtgaccccggacgccgccgcctctgcgccgcccgcgcgccgagccgcccccgggccccggccgcgctgctccgaggaagcggcggcggaccggggccggggcccggcatggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacagccagcagccgcctgatgggaagttctccggcctcctcgttcatgggcagtttcctcaccagcagcctgggctcggcagcctccacgcaccccagcggccccagctcctccccccctgagcaggcctaccgtggctcccaccccaccacctcccagatctggttctcccactcccacgaagctccggggtaccccagattttcggggagtctggcatccaccttcctacccgtgagccacttggatcaccatggaaacagcaacgttctctatgggcagcaccgtttctatggaacccaaaaagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 110652 - DNA, 1939 bp, Homo sapiens
  Payload ID: 1701
  Gene Symbol: BAIAP2
  Gene Name: BAI1-associated protein 2
  Uniprot ID: Q9UQB8
  ENST ID: ENST00000321280
  CDS Start-End: 134-1699
aaggtggccgccgccggacgccgggctctgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgag

SEQ ID NO: 110653 - DNA, 2879 bp, Homo sapiens
  Payload ID: 1701
  Gene Symbol: BAIAP2
  Gene Name: BAI1-associated protein 2
  Uniprot ID: Q9UQB8
  ENST ID: ENST00000321300
  CDS Start-End: 94-1752
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtgtgatctgtccgcccaagggccagaaggccgggagcacggggatgggagcgcccgcaccctggctggaagatgaacttcccgtaagcacgtaattccctgcaggtccggcagctacacctggagtgtggggcctggtccctccccatgcccctcggtggggctctcctgggcccctcactcccactggcaatgtcacaagggcctccccaggcccctcctgcctcgggcaggccccagccctcctccttacccaacctcccatccagaaccttgctgccagggcctcccagctcgctcctgcggccaaaggccagctgtcaggtgctatgcggggtcaccagcagagtgcccgctggcaggtgggggcttccccgcttccggggtctgccccaggactcctgggtggacctcccccccccacctccgctgactcctgcaggcactggggagctctgctggaattgggggttttaaaacttcattagcagatttgtgctcttccatactgtttgtttgtttgttaggtgaaatacagtgtggtgagctgcactggtgacaacagcccttacctggctggggaggtgtctccagcagagctcactcccgcctacagccactcacaccccggggacaggaagctgtagagttggcgggccaggagggcagttgagagctggccagcggagggtgcagggaagcccagctgtgctcaactctcctgcctccgccttccaccctgggcccagggacagacagacattgccctcagaagggcagggaggaggctgtcctggagaggcctgtaggtccattcttcacccgtccctaccaggccaactcggcctgcaggaagggagacctgcagggcgctacccctgcgcccccacacacagtagggccagaacaccatcccctccaccggggtgtgccgaggacagtggggaggagaggagaggggcagcttcctcctggccccaggaagggctggcatcgggttcctggcacagcccctcctgtccaggactttatcatcggcagacctcagaagacaacacacaaaggtttcttttgtcttagcttcatttctcttaaaaaacaaggaacaagaaaacattgcaccagcgttctaagcctcaaacaaaacacaaaacaaatccccctgcgaagcaacaataaactttacatctctttggcaacaat

SEQ ID NO: 110654 - DNA, 1442 bp, Homo sapiens
  Payload ID: 1701
  Gene Symbol: BAIAP2
  Gene Name: BAI1-associated protein 2
  ENST ID: ENST00000416299
  CDS Start-End: 1-1128
atgctcctcccagagggacagaggcagagagccctggggtttggaactgtcacttccacctacagccctgttggtcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccg

SEQ ID NO: 110655 - DNA, 2095 bp, Homo sapiens
  Payload ID: 1701
  Gene Symbol: BAIAP2
  Gene Name: BAI1-associated protein 2
  Uniprot ID: Q9UQB8
  ENST ID: ENST00000428708
  CDS Start-End: 105-1709
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 110656 - DNA, 2129 bp, Homo sapiens
  Payload ID: 1701
  Gene Symbol: BAIAP2
  Gene Name: BAI1-associated protein 2
  Uniprot ID: Q9UQB8
  ENST ID: ENST00000435091
  CDS Start-End: 94-1656
ccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagttagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgc

SEQ ID NO: 110657 - DNA, 581 bp, Homo sapiens
  Payload ID: 1701
  Gene Symbol: BAIAP2
  Gene Name: BAI1-associated protein 2
  ENST ID: ENST00000571530
  CDS Start-End: 161-581
ctttgcttcagatgtgttaagagtggcatccacgttctcgtctgcgaaatgacagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaagg

SEQ ID NO: 110658 - DNA, 748 bp, Homo sapiens
  Payload ID: 1701
  Gene Symbol: BAIAP2
  Gene Name: BAI1-associated protein 2
  ENST ID: ENST00000576756
  CDS Start-End: 359-748
gcatcttcttaagagccgattctgaactgaccactccttgacgggcaatcccggtggacggggggtctgagtcctgctgtggagggtctgcctgaggccggtaggggctcagcccaagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgc

SEQ ID NO: 110659 - DNA, 565 bp, Homo sapiens
  Payload ID: 1701
  Gene Symbol: BAIAP2
  Gene Name: BAI1-associated protein 2
  ENST ID: ENST00000575989
  CDS Start-End: 327-565
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtggaactgcgcccgggccccgtggggtgggagctgcctcctgagctggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtca

SEQ ID NO: 110660 - DNA, 567 bp, Homo sapiens
  Payload ID: 1701
  Gene Symbol: BAIAP2
  Gene Name: BAI1-associated protein 2
  ENST ID: ENST00000575958
  CDS Start-End: 161-567
gtcttgcacattgcagactgacgatggcttcctttttccagagccactcgtctgtgggacacttggtgacctcatctacggtagagtcttccgtagccctcacgtggctctccgaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgctt

SEQ ID NO: 110661 - DNA, 646 bp, Homo sapiens
  Payload ID: 1701
  Gene Symbol: BAIAP2
  Gene Name: BAI1-associated protein 2
  ENST ID: ENST00000573677
  CDS Start-End: 106-646
agaaatcacagcgagtcgagtattctcccagcttgtctgggcaggagacagggttgggcctgtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagc

SEQ ID NO: 110662 - DNA, 2512 bp, Homo sapiens
  Payload ID: 1701
  Gene Symbol: BAIAP2
  Gene Name: BAI1-associated protein 2
  Uniprot ID: Q9UQB8
  ENST ID: ENST00000575712
  CDS Start-End: 100-1638
tcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggtaaggggactttcagacctgtctttgggaccgtgggtgggtgtgaagaggccgggtggggcaggtccctctgctaggacctggggccacctcttttcctttagggcccagcctggcccttcacccctgtcagagccggggatgtcccttagggcgtcctgctttctccgagtgacacgggaacccccctgggccctgcccctctttcatcgcatctggccggccccatccatccctgtcaggcaaggttggggagggtagctgaggctggcatccatggctggggctgcagcctcctctgccccaatctgtgctccgcccttgtcctgggtcttcctggagggtcaggaggccaacgggagctgctgaaaggggcattgctcggtgctggcggactcgccgcctgtggctgggcagcgtcgtgcagccaggcagccgtcctgtgctttgtttcacagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatcttaaaaaaaaaaaaaaa

SEQ ID NO: 110663 - DNA, 631 bp, Homo sapiens
  Payload ID: 1701
  Gene Symbol: BAIAP2
  Gene Name: BAI1-associated protein 2
  ENST ID: ENST00000574804
  CDS Start-End: 96-272
gcgagtcgagtattctcccagcttgtctgggcaggagacagggttgggcctgtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcg

SEQ ID NO: 110664 - DNA, 782 bp, Homo sapiens
  Payload ID: 1701
  Gene Symbol: BAIAP2
  Gene Name: BAI1-associated protein 2
  ENST ID: ENST00000572073
  CDS Start-End: 79-782
gcaatttgacttgaatagctcaggacctgaactggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgccca

SEQ ID NO: 110665 - DNA, 626 bp, Homo sapiens
  Payload ID: 1701
  Gene Symbol: BAIAP2
  Gene Name: BAI1-associated protein 2
  ENST ID: ENST00000572918
  CDS Start-End: 100-626
agttgtattctgcctgctgcaccatgcaaatgcgctccttcagcccgcagacactcctctgcggccgggtttcttcttaccccctttgcacagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgctt

SEQ ID NO: 110666 - DNA, 584 bp, Homo sapiens
  Payload ID: 1701
  Gene Symbol: BAIAP2
  Gene Name: BAI1-associated protein 2
  ENST ID: ENST00000575750
  CDS Start-End: 106-426
tgtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgccctgccctgcctcctgttccgggtccatgtgttggagctgacggctgatgtgttttctctccatgtccagctgaagtcttttcacaacgagctgcttacgcagctggagcagaaggtggagctggactccaggtatctgagtgctgcgctgaagaaataccagactgagcaaaggagcaaaggcgacgccctggacaag

SEQ ID NO: 110667 - DNA, 858 bp, Homo sapiens
  Payload ID: 1701
  Gene Symbol: BAIAP2
  Gene Name: BAI1-associated protein 2
  ENST ID: ENST00000572498
  CDS Start-End: 1-649
gcccaaatccctgtctcctccgcagtctcagagcaagctcagcgactcctactccaacacactccccgtgcgcaagagcgtgaccccaaaaaacagctatgccaccacagccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcaggaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagaccca

SEQ ID NO: 110668 - DNA, 2133 bp, Homo sapiens
  Payload ID: 1701
  Gene Symbol: BAIAP2
  Gene Name: BAI1-associated protein 2
  ENST ID: ENST00000572329
  CDS Start-End: 105-554
gtggttcgggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagtggcagcggcacgctggtgtccacagtgtgaggacgctgaccccgggcagccgctgctctgaagagcttccgcgccttccccctggtctcgtccgttttcctcctcagctctcgctggtttgttcttgggttgtttttcttttccacctgccccatgccttttggttggtgaccccagactctgtgatcccccagggtccatggtgctgctccatccgccccccctcccctgtgtttacgcgccccatcctgtgtgtcccagccttttgagcagaaactgccaggcaggacctgctgggccgtgcggggcaccctcggcctcaccctgcagtgtctgtggcactcactgcttttctaaggctcgccgtgagccaggtctaaagtttgaagaaaaagaaaaatctt

SEQ ID NO: 110669 - DNA, 509 bp, Homo sapiens
  Payload ID: 1701
  Gene Symbol: BAIAP2
  Gene Name: BAI1-associated protein 2
  ENST ID: ENST00000575841
  CDS Start-End: 1-294
cagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcggaccgggccctgtgtagagacccttccgcgccggcgttcccgctccgctaaagatttcaaatccaggggattccatgctcaatggatgaatgtagacacaaaacagcaacacttgtatgaagatgtaaagtgctgaacatatttttttcctgtttcctttccttttttttaaaaaatctgaattgtgccctgtactgcagttacttgtttgaataaaagttttatttattgc

SEQ ID NO: 110670 - DNA, 2229 bp, Homo sapiens
  Payload ID: 1701
  Gene Symbol: BAIAP2
  Gene Name: BAI1-associated protein 2
  ENST ID: ENST00000575245
  CDS Start-End: 98-1759
gggtccgctttcgtctccgtcctgctgccgttaccgccgctgctgccgccgcttgcgtcccccgctccggtctgtggtgcagccgggacccaggaccatgtctctgtctcgctcagaggagatgcaccggctcacggaaaatgtctataagagggtggaagagaagtaccagcggaacctttttcctattttttctccttctgcgctgaaaccagaaagcaggaactttcgtggtgagagttggcaggggaccatcatggagcagttcaaccctagcctccggaacttcatcgccatggggaagaattacgagaaggcactggcaggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagggcgagctggagaattacgtgtccgacggctacaagaccgcactgacagaggagcgcaggcgcttctgcttcctggtggagaagcagtgcgccgtggccaagaactccgcggcctaccactccaagggcaaggagctgctggcgcagaagctgccgctgtggcaacaggcctgtgccgaccccagcaagatcccggagcgcgcggtgcagctcatgcagcaggtggccagcaacggcgccaccctccccagcgccctgtcggcctccaagtccaacctggtcatttccgaccccattccgggggccaagcccctgccggtgccccccgagctggcaccgttcgtggggcggatgtctgcccaggagagcacacccatcatgaacggcgtcacaggcccggatggcgaggactacagcccgtgggctgaccgcaaggctgcccagcccaaatccctgtctcctccgcagtctcagagcaagctcagcgactcctactccaacacactccccgtgcgcaagagcgtgaccccaaaaaacagctatgccaccaccgagaacaagactctgcctcgctcgagctccatggcagccggcctggagcgcaatggccgtatgcgggtgaaggccatcttctcccacgctgctggggacaacagcaccctcctgagcttcaaggagggtgacctcattaccctgctggtgcctgaggcccgcgatggctggcactacggagagagtgagaagaccaagatgcggggctggtttcccttctcctacacccgggtcttggacagcgatggcagtgacaggctgcacatgagcctgcagcaagggaagagcagcagcacgggcaacctcctggacaaggacgacctggccatcccaccccccgattacggcgccgcctcccgggccttccccgcccagacggccagcggcttcaagcagaggccctacagtgtggccgtgcccgccttctcccagggcctggatgactatggagcgcggtccatgagcagcgccgatgtggaagtggccagattctgagccgcctgactagagaatccctttgcccacgtccagctgaagccgacagtgaccaacgacaggtctgcccccctcctcagctgatggccacatctgcagtgctgcccatctggtggcttcccccgcccttcccatgtagcctgttctgtcatcatctgtgcgttcctgtgtagagaacatccaggccccggctgcctggtcttgccccacttgagtctggcctggactggatcccagctgttctaggcagggccgggcagagtggggcgcaggcccctgaagggcgagacccagtggctgggctgcccagggctgaggggccgcctcttgagggtacacgcctctggtcacatggccatggagccttgggtacccctgagttaagggaggacatttggccagctggtggctgggaggggagcctggctgccctgctgcttctcctgcctaataaacaggcttctcctgca

SEQ ID NO: 110671 - DNA, 578 bp, Homo sapiens
  Payload ID: 1701
  Gene Symbol: BAIAP2
  Gene Name: BAI1-associated protein 2
  ENST ID: ENST00000573659
  CDS Start-End: 236-578
gagatgctgggaggcccctcaggcggcggcaataccaagtaatgcctttagcctcctttgatcagctgtgacgggcgtcctggtctgagactgtgaagcaattggaaatagttctcccactccaggctcagcttggggatctgtggggaaatggcttcctactgcccagctctgcagtttccttgcccagggtgtgacgtatgcagccaaaggctactttgacgccctggtgaagatgggggagctggccagcgagagccagggctccaaagaactcggagacgttctcttccagatggctgaagtccacaggcagatccagaatcagctggaagaaatgctgaagtcttttcacaacgagctgcttacgcagctggagcagaaggtggagctggactccaggtatctgagtgctgcgctgaagaaataccagactgagcaaaggagcaaaggcgacgccctggacaagtgtcaggctgagctgaagaagcttcggaagaagagccagggcagcaagaatcctcagaagtactcggacaaggagctgcagtacatcgacgccatcagcaacaagcagg

SEQ ID NO: 110672 - DNA, 3622 bp, Homo sapiens
  Payload ID: 1702
  Gene Symbol: BAIAP2L1
  Gene Name: BAI1-associated protein 2-like 1
  Uniprot ID: Q9UHR4
  ENST ID: ENST00000005260
  CDS Start-End: 217-1752
ctcctctgctcctcgaagaaggccagggcggcgctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttactgtattttttaaatgaattttttccttaataacagccagaataagggatagtctatgctttcaggactggctttctgcacctgatatgaatgagaccagttttattttataaagcatgtgctcttaatagcattatgtctaaagaagatatcacgtaagtttgcatcttagcatgcaaatcataattttaagcaatataaattatgaaaatactatataaatgtaatttaacttaaaatgtttaagtgtagagcttccagagatggagaaacccccaccctccctccaaccacgccagagctgtagagtgctaagacgctttgcctgcccttatcacagccacacgtagcactcgacgaaatctcctccgagagctccttttcttggtagttaggagtcgccaacggattcgctgcacacggcccatccaggacacaggcctgggcgtcggagtcacggctccttgtgttctcactcagctagttggccaaagctgcatccattaccagtacactcaaactgctcggggtcctggtttctccgtgtttgaatcaggtacagactctcaaaggatacgtgtaaagccaggatgacctctggtgcctggagaagggcgggtttttcagcctagcagccatgatgccctcggaacctggccctatggtatggatgtgaggactacgcactggctgccctgagcccggggctggaaatcatctttggctgccaaggatctggacctattttggagtggagagtcatggttaaaattcccagcccggcccaggtacgggaatcccagcattttgtgaggccgaggcagggggatcacctgaggtcaggagtctctactaaaaatacaaaaattagacaggtgtggtggtgggcgccactcaggaggctgaggcaggagaatcacttgaacccgggaggcagaggttgcagtgagccagatcatgctgctgcactccagcccggccgctcaccgtgtgtgttgctgggtgctggggctgtgacttatcccctctcctttagccttgccataagtgtagtatcctatgaggctgagattgggaaaggttacatgcaggtaagccagtggacgtggccgatgcttcaggctccttccagccaggtccagcagtgttaccatctgcttctcctgggaggacaaaccaggcacccccaccatgaaggggctgcaggcaccatgaactatgttaacaaccccagtctgtactacagaaagggctgcagccacatgagaattcagtccacacaagccccatggccgtgttccccacttcagccacagggctcagggagccccatctggcgctaaggggaactgctggggtgtgggtgacacctggcctttggcgttctgccttggggaggtttctggttttgttacggggtggaagaataggacctgggggtctcggatgcaacctgcagaccccgtggctcacccaaccccaggttctgcctcccagaccagaacgggcatggcctggtccttggcaccgaggtgcctgctctgtaaatatcaagggattacaactttaataataaagcagaacttgaaaac

SEQ ID NO: 110673 - DNA, 2065 bp, Homo sapiens
  Payload ID: 1703
  Gene Symbol: BAIAP2L2
  Gene Name: BAI1-associated protein 2-like 2
  Uniprot ID: Q6UXY1
  ENST ID: ENST00000332536
  CDS Start-End: 121-1668
tccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccacctgcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgc

SEQ ID NO: 110674 - DNA, 2146 bp, Homo sapiens
  Payload ID: 1703
  Gene Symbol: BAIAP2L2
  Gene Name: BAI1-associated protein 2-like 2
  Uniprot ID: Q6UXY1
  ENST ID: ENST00000381669
  CDS Start-End: 146-1735
gcaggcctccatctccaggtccctctccgaggcttcctcgctgccagctgagtcgtgggcacctgagggactacctaccactgctcccggctgtgccatcgccaccagctcccagcctcctgctcagacccgggacagcccctccatggcccccgagatggaccagttctacaggtccaccatggccatctacaagagcatcatggagcagtttaaccccgccctggagaacctggtgtacctgggcaacaactacctgcgtgccttccacgctctgtccgaggcggccgaggtctacttcagtgccatccagaagattggggagcgtgccctgcagagccccacctcacagattctgggggagatcttggtgcagatgtctgacacccagcggcacttgaactctgacctggaggtggtggtgcagacattccatggaggcctgctgcagcacatggagaagaacaccaagctggacatgcagttcatcaaagacagccgccagcactatgagctcgagtaccgccaccgagcggccaacctggagaagtgcatgtctgagctgtggcgcatggagcgcaagagagacaagaacgtgcgggagatgaaggagagtgtgaaccggctgcacgcacagatgcaggccttcgtgtctgagagtcagcgggcggctgaattggaagagaagcggcgctatcgcttcctagcagagaagcacctgctactttccaacaccttcctgcagttcttcggccgggcccgggggatgctccagaaccgcgtgctgctgtggaaggagcagtctgaggccagccgcagcccgtcgcgcgcccactcccccggcctgctgggccccgcgctggggccgccctacccctcgggccgcctgacgcccacctgcctggacatgcccccgaggcccctgggagagttcagctccccccgcagccggcacggctccggctcctacggcaccgagcccgacgcgaggcccgcgtcccagctagagccagaccgtcgctccctgccccgcacgccgtcggcctcctcgctctacagcggcagcgcccaaagctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccatagcaccctcggagtactgggatggccagtcccgctcccgcaccccaagccgggtgccaagccgtgcccccagccctgcacctccacccttgcccagcagccgccgcagcagcatgggcagcacagcagttgccactgacgtcaagaaactgatgtcctcagagcagtacccaccacaggagctcttcccgaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagaccaccccggcagcctgagcagctccaaagcactggcttggggtccgagaccttcaaagtaaagcaggcggaatggggggacaggacaatttctccccctccaggggctccaggactctccctggggggcccacctcttgccccctaacctctttcccccttttctgcccccgtggggaggagccccttgtacctgctccgtgcccaacacatgccctctctgtacatcttttgtaaatgatgagaaataaaggaagtggacgcaaagtgatgcggca

SEQ ID NO: 110675 - DNA, 751 bp, Homo sapiens
  Payload ID: 1703
  Gene Symbol: BAIAP2L2
  Gene Name: BAI1-associated protein 2-like 2
  ENST ID: ENST00000428572
  CDS Start-End: 1-591
agctcgcgctccaactcctttggcgagcgcccgggcggcggcgggggcgccaggagagtccgcgccctggtctcccactcggagggcgccaaccacacgctgctgcgcttctccgctggggacgtggtggaggtgttggtgcccgaggcccagaacggctggctctacggcaagctggagggctcgtccgcgagcggttggttccccgaggcgtacgtgaaggctctggaggaggggcccgtgaatcccatgacccccgtgacccccatgacctccatgacctccatgtcccccatgacacccatgaaccccgggaacgagctgccttccaggtcctacccactccggggcagccacagcctcgatgacctcctggaccggccgggcaactccatagcaccctcggagtactgggatggccagtcccgctcccgcaccccaagccgggtgccaagccgtgcccccagccctgcacctccacccttgcccagcagccgccgcagcagcatgggcagcacagcagttgccactgacgtcaaggggcacaaatccttttgccactgtcaagcttcgtcccaccatcaccaatgaccgctcagcacccctcatccgctgaggcggggtccgaggtcgtaccccacagtgcacctgcccaggggctgttcagagctggcaatggcagcgacagcagcaacagcagcagatccaagaagcgggtccctgagacggggggtggctgccctccccagac

SEQ ID NO: 110676 - DNA, 4678 bp, Homo sapiens
  Payload ID: 1704
  Gene Symbol: BAIAP3
  Gene Name: BAI1-associated protein 3
  Uniprot ID: O94812
  ENST ID: ENST00000324385
  CDS Start-End: 159-3722
agacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctc

SEQ ID NO: 110677 - DNA, 4583 bp, Homo sapiens
  Payload ID: 1704
  Gene Symbol: BAIAP3
  Gene Name: BAI1-associated protein 3
  Uniprot ID: O94812
  ENST ID: ENST00000397488
  CDS Start-End: 118-3627
tcagtcgtcggcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggcctggggctctccctgccgtcagagccctcaccctgggccccacacacaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctc

SEQ ID NO: 110678 - DNA, 3930 bp, Homo sapiens
  Payload ID: 1704
  Gene Symbol: BAIAP3
  Gene Name: BAI1-associated protein 3
  Uniprot ID: O94812
  ENST ID: ENST00000426824
  CDS Start-End: 160-3618
agtcagaccccgcccccgcagcggcgtccgcccagcagttgctcagtcgtcggcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggct

SEQ ID NO: 110679 - DNA, 3875 bp, Homo sapiens
  Payload ID: 1704
  Gene Symbol: BAIAP3
  Gene Name: BAI1-associated protein 3
  Uniprot ID: O94812
  ENST ID: ENST00000421665
  CDS Start-End: 214-3564
actggcttcgggggacagcagggggagcagcctcttccacccagcaagggaggggaagggggcttgtgactcccaggcccctgaggatttcacgactggctgtgggggtgacagcttccagaagcactgtacccagcctaccaagcccccccatcttttgggggggaggctcacaggggaaggcactgataggtttgaaggaggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccggagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggc

SEQ ID NO: 110680 - DNA, 571 bp, Homo sapiens
  Payload ID: 1704
  Gene Symbol: BAIAP3
  Gene Name: BAI1-associated protein 3
  ENST ID: ENST00000561793
  CDS Start-End: 1-571
ctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctg

SEQ ID NO: 110681 - DNA, 3763 bp, Homo sapiens
  Payload ID: 1704
  Gene Symbol: BAIAP3
  Gene Name: BAI1-associated protein 3
  Uniprot ID: O94812
  ENST ID: ENST00000568887
  CDS Start-End: 116-3490
agtcgtcggcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggct

SEQ ID NO: 110682 - DNA, 699 bp, Homo sapiens
  Payload ID: 1704
  Gene Symbol: BAIAP3
  Gene Name: BAI1-associated protein 3
  ENST ID: ENST00000566162
  CDS Start-End: 1-653
gctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggcccatttatgtccctcatgtctctagattttctcgtcacccagcctcaaaaatatatgtgtctgcaaccctc

SEQ ID NO: 110683 - DNA, 3663 bp, Homo sapiens
  Payload ID: 1704
  Gene Symbol: BAIAP3
  Gene Name: BAI1-associated protein 3
  Uniprot ID: O94812
  ENST ID: ENST00000562208
  CDS Start-End: 116-3505
agtcgtcggcgcgcgcggctgggagcggtagctgtgcctcggcgtccccgagctggtgccgagcgcagcgccccaggagcccccccatccccgcgccggcccacggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctgg

SEQ ID NO: 110684 - DNA, 4732 bp, Homo sapiens
  Payload ID: 1704
  Gene Symbol: BAIAP3
  Gene Name: BAI1-associated protein 3
  Uniprot ID: O94812
  ENST ID: ENST00000628027
  CDS Start-End: 264-3773
agacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggcctggggctctccctgccgtcagagccctcaccctgggccccacacacaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagt

SEQ ID NO: 110685 - DNA, 3423 bp, Homo sapiens
  Payload ID: 1705
  Gene Symbol: BBS1
  Gene Name: Bardet-Biedl syndrome 1
  Uniprot ID: Q8NFJ9
  ENST ID: ENST00000318312
  CDS Start-End: 52-1833
attgggcgttacgcgagggcggggccggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatggagttaatgagttgc

SEQ ID NO: 110686 - DNA, 1790 bp, Homo sapiens
  Payload ID: 1705
  Gene Symbol: BBS1
  Gene Name: Bardet-Biedl syndrome 1
  Uniprot ID: Q8NFJ9
  ENST ID: ENST00000393994
  CDS Start-End: 6-1346
cgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaaggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtaggccccgcacttgtaccacgtggaaggtgagcaggaccctggggaggacagtaagggtgagtgccaacaaagaccttagggggctcctgggtgggggtgggggtatctgcacagtggagccctgtggcctgtcattagggccagcgcagaccaggcaaggggtcaggggtgtatgccccctgctgccatggccactcctccataggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacct

SEQ ID NO: 110687 - DNA, 1552 bp, Homo sapiens
  Payload ID: 1705
  Gene Symbol: BBS1
  Gene Name: Bardet-Biedl syndrome 1
  ENST ID: ENST00000455748
  CDS Start-End: 19-1509
aggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggag

SEQ ID NO: 110688 - DNA, 601 bp, Homo sapiens
  Payload ID: 1705
  Gene Symbol: BBS1
  Gene Name: Bardet-Biedl syndrome 1
  ENST ID: ENST00000525809
  CDS Start-End: 25-601
gttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagt

SEQ ID NO: 110689 - DNA, 1001 bp, Homo sapiens
  Payload ID: 1705
  Gene Symbol: BBS1
  Gene Name: Bardet-Biedl syndrome 1
  ENST ID: ENST00000532908
  CDS Start-End: 12-269
cgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcattt

SEQ ID NO: 110690 - DNA, 3585 bp, Homo sapiens
  Payload ID: 1705
  Gene Symbol: BBS1
  Gene Name: Bardet-Biedl syndrome 1
  ENST ID: ENST00000526760
  CDS Start-End: 55-312
actattgggcgttacgcgagggcggggccggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtaggccccgcacttgtaccacgtggaaggtgagcaggaccctggggaggacagtaagggtgagtgccaacaaagaccttagggggctcctgggtgggggtgggggtatctgcacagtggagccctgtggcctgtcattagggccagcgcagaccaggcaaggggtcaggggtgtatgccccctgctgccatggccactcctccataggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacctagggcggctcaactcctcccacagcaccaacccagcatggtcccactgaagtcctactacgccctcccctccccagccttttccagaaaccatactgggctcagatcagagctccgaagcggtcaaagtgagctgagcaggacaggcccagcctttctccactgccacgtccctcatgcacatcactcatctcctgctgcaggccaaggccaaaattgggctagtcctggccagggaaatcagaagctcttcttgggtgagattgagcctcctgttgctccctggagttccggaggctgggctgcagcccactcagcttgcgggcaaaatacgtgctctcctctctccttgtcagctgagcaaacccagggaatagccctcctctccccaggaaacttctctgaaatcttagacttagccagtcttaggcctacgatgccacacaaaggttgttcagggagaagggggtgcaggaggcagagggtgccccgcagggagctggtggctccagccccactagagctcctaaagatcacacagcagctgctcctgacagggatgctcatgcccagaaagcaagcccaggagaggaaggcagagtgtgacagagcagagccagggccaggcgcaccaggagaggcgtttctggggctccagagaagtgccacgggaggcagaagtccagaactgcccatatagatgcccttctacatcctggagcccaaatcagtcatgtgggtgggaagttcccagggcagtggtcacatcgtgagaattagcaggaaaggcggggcctttcttgtcatagctatttctgaggatgaaatgggagacatatgcccagcacctgatgtaagtttatataatgtaatattatgtacctaccactaagaaatacatgaaccgtgccatgaggacagtaagtgttcataaagcaacatgaagcaagaaacagtgcagggtgcccagtgcacacactagagagaaattgtgaacattaaggacaaggagaattggtgtctttctaaaacatacttatttaaaaacacatacccacttactaatgtggaattacacagtttgtaacaagaaaacagtctctcccattctctagtactgctcccctacccagcagtcacttccagttcattcagctatttttaaaatgtgcttatatgactcttgcttgatatatcaatcttagacattacctgttgactccctgttgtcatacatgaggctttagctctcttttgtcagcaaccctcccccatccctagttattaggttaaaaaatactcagattactatttctattactatgtgaaagttaactgcggagccaagagttggactataattaaattaccttccttgtactttctttttaatgg

SEQ ID NO: 110691 - DNA, 822 bp, Homo sapiens
  Payload ID: 1705
  Gene Symbol: BBS1
  Gene Name: Bardet-Biedl syndrome 1
  ENST ID: ENST00000526035
  CDS Start-End: 17-274
gacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccc

SEQ ID NO: 110692 - DNA, 1034 bp, Homo sapiens
  Payload ID: 1705
  Gene Symbol: BBS1
  Gene Name: Bardet-Biedl syndrome 1
  ENST ID: ENST00000527251
  CDS Start-End: 441-608
gttacgcgagggcggggccggttgccaggacgacgcctgcgaagatggccgctgcgtcctcatcggattccgacgcctgcggagctgagaggtgaaggcagggctcctcaaggcctcttttcccacccgtgtaaagagggtcccttggtccccgggctctgggctcctgctgttctcgggcagtctggaaggactcttaagaggtcagatagggaaaccgaggcctaagatgtgcatatgtgtgtctggaggtcgctcggtgagccagtggcggagcctggacttgtacccagacgttctgtaccttatgttcagagtgacctgtaccagcttcctcaaagtttttttttcccctcccatgggactcactccccaactgtctttcccccacttccagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagc

SEQ ID NO: 110693 - DNA, 1043 bp, Homo sapiens
  Payload ID: 1705
  Gene Symbol: BBS1
  Gene Name: Bardet-Biedl syndrome 1
  ENST ID: ENST00000533557
  CDS Start-End: 26-283
ggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagatgatcatacaagccaccatagtgaaggtgggcggaagacaagacaccatagtgaaggtgggaggaagacaagacaccatagtgaaggtgggaggaagacacacttgatgttttccaaggccacacatttactaaggtggcagaagtggaaataatcccagggtcatctgctttggggccagtgttcctcccagagactccaagcaccccaagtactgcatcgagctgagcgcccagcctgtgggacttatccgggtacacaaggtccta

SEQ ID NO: 110694 - DNA, 910 bp, Homo sapiens
  Payload ID: 1705
  Gene Symbol: BBS1
  Gene Name: Bardet-Biedl syndrome 1
  ENST ID: ENST00000533644
  CDS Start-End: 52-546
attgggcgttacgcgagggcggggccggttgccaggacgacgcctgcgaagatggccgctgcgtcctcatcggattccgacgcctgcggagctgagagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtccta

SEQ ID NO: 110695 - DNA, 891 bp, Homo sapiens
  Payload ID: 1705
  Gene Symbol: BBS1
  Gene Name: Bardet-Biedl syndrome 1
  ENST ID: ENST00000524458
  CDS Start-End: 38-205
ggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagagggagacggcagaggagcctttgtccatccagtcactcaggtaaggaccctgtggagggccagggtttgggaggctccagggagaggaagcagccgccagaatgtgccagaatgatggaggagggcagcgaggccggggcctgcagatgccagttctctgtgtgtctaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacac

SEQ ID NO: 110696 - DNA, 584 bp, Homo sapiens
  Payload ID: 1705
  Gene Symbol: BBS1
  Gene Name: Bardet-Biedl syndrome 1
  ENST ID: ENST00000526815
  CDS Start-End: 423-584
cggttgccaggacgacgcctgcgaagatggccgctgcgtcctcatcggattccgacgcctgcggagctgagaggtgaaggcagggctcctcaaggcctcttttcccacccgtgtaaagagggtcccttggtccccgggctctgggctcctgctgttctcgggcagtctggaaggactcttaagaggtcagatagggaaaccgaggcctaagatgtgcatatgtgtgtctggaggtcgctcggtgagccagtggcggagcctggacttgtacccagacgttctgtaccttatgttcagagtgacctgtaccagcttcctcaaagtttttttttcccctcccatgggactcactccccaactgtctttcccccacttccagcaatgaggccaattcgaagtggttggatgcgcactacgacccaatggccaatatccacaccttttctgcctgcctagcgctggcagatttacatggggatggggaatacaagctggtggtaggggaccttggccctggtgggcagcagccccgcctgaaggtgctcaaaggaccactggtgatgaccgaaagcccgctacctgct

SEQ ID NO: 110697 - DNA, 333 bp, Homo sapiens
  Payload ID: 1705
  Gene Symbol: BBS1
  Gene Name: Bardet-Biedl syndrome 1
  ENST ID: ENST00000524705
  CDS Start-End: 134-333
gcaatgaggccaattcgaagtggttggatgcgcactacgacccaatggccaatatccacaccttttctgcctgcctagcgctggcagatttacatggggatggggaatacaagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccg

SEQ ID NO: 110698 - DNA, 1934 bp, Homo sapiens
  Payload ID: 1705
  Gene Symbol: BBS1
  Gene Name: Bardet-Biedl syndrome 1
  ENST ID: ENST00000630659
  CDS Start-End: 6-263
cgaagatggccgctgcgtcctcatcggattccgacgcctgcggagctgagagcaatgaggccaattcgaagtggttggatgcgcactacgacccaatggccaatatccacaccttttctgcctgcctagctggtggtaggggaccttggccctggtgggcagcagccccgcctgaaggtgctcaaaggaccactggtgatgaccgaaagcccgctacctgctctgccagctgctgctgccaccttcctcatggagcaacatgagccccggaccccagctctggcacttgcttcaggcccttgtgtctatgtgtataagaatctcagaccctacttcaagttcagcctgccccaattgcctccaaatcctctggaacaagacctttggaaccaggccaaagaggaccgaatcgaccccttaaccctgaaggagatgctggagagcatccgggagacggcagaggagcctttgtccatccagtcactcaggtttctgcagctggagctaagtgaaatggaggcatttgtaaaccaacacaagtccaactccatcaagcggcagacagtcatcaccaccatgaccaccttgaagaagaacctggctgacgaggatgctgtgtcttgcctggtgctgggcaccgagaacaaggagctcctggtgcttgaccccgaggccttcaccattttagccaagatgagccttcccagcgtccccgtcttcctagaggtttctggccagtttgatgttgagttccggcttgccgcggcctgccgcaatggaaacatctatattctgagaagagactccaagcaccccaagtactgcatcgagctgagcgcccagcctgtgggacttatccgggtacacaaggtcctagtggtgggcagcacccaagacagcctgcatggcttcacccacaaggggaagaagctgtggacagtgcagatgcccgcagccatcctgaccatgaacctcctggagcagcattcccggggcctgcaggccgtcatggctgggctggccaatggagaggtccgcatttatcgtgacaaggccctgctcaatgtcatccacaccccggatgcagtgaccagcctttgctttggccggtacgggcgggaggacaacaccctcatcatgaccactcgaggtggtggcctgatcatcaagatcctgaagcgtacagcagtgtttgtagagggaggaagtgaggtgggtcccccaccagcccaggccatgaaactcaatgtgccccgaaagacccggctttacgtggatcagacactgcgagagcgggaggctggcaccgccatgcaccgggccttccagacagacctatacctgctgcgcctacgtgctgcccgcgcctacctgcaggccctcgagtccagcctgagccccctgtccacgacagcccgagagccactcaagctgcacgccgtggttcagggccttggccccacctttaagctcacacttcacctgcagaacacctcaacaacccgtcctgtcctggggctgctggtctgcttcctgtacaacgaggcgctctattccctgccccgggccttcttcaaggtacccttgctggtgccagggctcaactaccccctggagacctttgtggagagtctcagtaacaagggcatctcagacatcatcaaggtgctggtgcttcgagaaggccaaagtgcacccctgctgagtgcccacgtcaacatgcctgggagcgaggggctggcggccgcctgagacctgagctgctgtgaaagcccctgcacaatcagccagggagaactgggcgggtttagtggccccaggcccactcctcatgcagcagtgtgctggggcgacagctcgtctcccctctcttaagcacccgcttcctcaccacccccactgttgggcctatagtagcaggttagtgagtacct

SEQ ID NO: 110699 - DNA, 3595 bp, Homo sapiens
  Payload ID: 1706
  Gene Symbol: BBS10
  Gene Name: Bardet-Biedl syndrome 10
  Uniprot ID: Q8TAM1
  ENST ID: ENST00000393262
  CDS Start-End: 85-2256
attccgtttccggccgttcccacccctgttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtggggcccgagggacggcaagttttgtgtacgaagcccactggcgaggtgcttctcagccggaatggaggccgcctcctggaggcgctacacttagagcatcccatagccaggatgatagtggactgtgtttccagtcatctcaaaaaaacaggagatggtgcaaaaacatttattatctttctttgccatttgcttagaggacttcatgcaatcacagacagagaaaaggatcctttgatgtgtgaaaacattcaaacccatggaaggcattggaaaaattgttctcggtggaaatttatttcccaggctctcctaacgtttcagacacaaatattagacggtattatggaccagtacctaagtagacactttttgtctatcttttcgtctgctaaagagagaacattgtgtaggagctctttagagttgctcttagaagcatacttttgtggaagagtgggaagaaataatcataaatttatttcacagttgatgtgtgactactttttcaagtgtatgacttgtaaaagtgggattggtgtatttgagttagtggatgaccattttgtagagttgaatgttggtgtcactggccttcctgtttcagattccaggatcatagctggtcttgtgcttcagaaagatttttctgtgtaccgcccagcagatggtgacatgcgaatggtgatagtaacagaaaccattcagcctcttttttccacttctggatcagagtttattctaaattcagaagcacagtttcagacatctcaattttggattatggaaaagacaaaagcaataatgaaacatctacatagtcagaatgtaaaattgctcatatctagtgtgaaacaaccagatttagttagttattatgcaggggtgaatggcatatcagtggttgagtgtttatcatcagaagaagtttctcttatccggaggatcattggtctttctccatttgtaccaccacaggccttttcgcagtgtgaaatacctaacactgctttggtgaaattttgtaaacctcttatccttagatccaaaagatatgttcatctaggcttgataagcacatgtgcatttataccacactctatagttctttgtggaccagtgcatggtctcattgaacaacatgaggatgctttacatggagcacttaaaatgcttcggcaattatttaaagaccttgatctaaattacatgacacaaaccaatgaccaaaatggcacttcaagtctttttatttataagaacagtggagaaagttatcaagcaccagatcctggtaatggctcaatacaaaggccttatcaggacacagttgcagagaacaaagatgcattggaaaaaactcaaacatatttaaaagtacattctaatttggtaattccagatgtagaattagaaacatatattccgtattcaacccccacactgacaccaacagatacattccaaacagttgaaacgctgacatgtttgtctttggaaagaaacaggctaactgattattatgaaccattactcaagaacaattccactgcttattcaacaaggggaaatagaatagaaatttcttacgaaaatttacaggtcacaaatattactagaaagggaagcatgttaccagtgagctgtaagttaccgaatatgggtacttcccagagttacctttcctcatctatgccagctggttgtgttttgccagtaggtggtaattttgagatcttgttacattactatcttctcaattatgccaaaaaatgccatcaatcagaagaaaccatggttagtatgataatagctaatgcacttttaggcattcccaaagtcctttataaatctaaaacaggaaagtacagctttccacatacatatataagagctgtccatgcactgcaaaccaatcaacccttggtaagcagtcagacaggtttggaatcagtaatgggtaaataccagctactaacttcagttcttcagtgtttgacaaaaatattaaccattgacatggtaatcactgttaagagacaccctcagaaagttcacaatcaagattcagaagatgaactataacatcagaagtttttaattaaccaaacttttcatctaactcaagccaagtaaagcagtcatgtgaccactggttctaaagtcagttcagtctacttaggaaaatagcgtaactttaaaagtctttagaagaagcacactaaggtcaccagaccagatacaaatattaaattactttatggaacaaatctagaggggaagccaagatttggctaagtgtgtctgttttttccctattttatgcctctgtgtctcagctctgtgttagcctatgtgtttaggggagggtttttctttatagctcctttttactctcctgtatctttttcactccagccctccttcatcgttacatgtttagttcatagaatcatttaatctctgatttgggtgggcttattctaattgtttttaatattgaatacattatttgcattaattttccctactcatactttgtaaagctgagtaaaaggctcaaattatttttttcaaaaagcataaaattaaattagcagtgagtaaaaggctcaaattttttttcaaaaagcataaaattaatttttacttttatgtggtcattggtttactgccacttcatttggaaaacttggatagattttcacctttgatatacctttgaatatatgttacctgaaatataactgtgcattgttaactctttcatttctgtagtaaaaggttaatactagaaaggatatgcaattaatactttgattttctcctgaccccaagagcttgtaaggatatgtcatgtatttactggtttttcttgtatctggtgcatagccagagttccacagtaacaaataatttgacaatttttatttctaatgtttatttctgttttatttttaatttttatttctaatttatttcatttacaaatgttcatattttaaaaacttgtcaatgtaaataatatgatgcatcttatcatggacaaggacagtgttttctacctttatcagttctctgtaatacccaaaacagtgctgtatttactccaagtattcagaagtgcttgttgaacaaaacagtgttatctttaattcattcctttaaatacatgtttccagtttacttattcaacagattcttacttgggattgactgaagaaaaaaaactttaattatagttgaataagtgttgactaatgtattttaaaaactataatatcaaaattttttatattaaatgtaattctgattttttaaacatttatgctatatgatgcattattttgtttctgtgaatatggagagaataaattagctcttttgctgaattcatggatgaatgaactttaaaactgctgca

SEQ ID NO: 110700 - DNA, 3244 bp, Homo sapiens
  Payload ID: 1707
  Gene Symbol: BBS12
  Gene Name: Bardet-Biedl syndrome 12
  Uniprot ID: Q6ZW61
  ENST ID: ENST00000314218
  CDS Start-End: 194-2326
gtctcttagcaactaagcccccggctcctccagaagcccctcttcgcacatgcgcaaactgcggacggggaactgggctccctagccctggcgtttttggtgttgctgtcccagccagaatcgcgtctggccggtgggaagccgggaactccagccccctgtaggagaggagaaaggagcgagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgta

SEQ ID NO: 110701 - DNA, 859 bp, Homo sapiens
  Payload ID: 1707
  Gene Symbol: BBS12
  Gene Name: Bardet-Biedl syndrome 12
  ENST ID: ENST00000433287
  CDS Start-End: 287-859
tttggtgttgctgtcccagccagaatcgcgtctggccggtgggaagccgggaactccagccccctgtaggagaggagaaaggagcgaggcaggagaggaaaacaagtgcaaagtgcattcttgaagcactctgtcaaatcacttttcatgcttcattgagtagaaacatggcacattttccaaagccatcagcctgtcttgttcatattatatcccagacagacacgcaagtattgtaatcattgataaaaatctcattaggcttctggaaaatagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctggg

SEQ ID NO: 110702 - DNA, 3431 bp, Homo sapiens
  Payload ID: 1707
  Gene Symbol: BBS12
  Gene Name: Bardet-Biedl syndrome 12
  Uniprot ID: Q6ZW61
  ENST ID: ENST00000542236
  CDS Start-End: 382-2514
gtctcttagcaactaagcccccggctcctccagaagcccctcttcgcacatgcgcaaactgcggacggggaactgggctccctagccctggcgtttttggtgttgctgtcccagccagaatcgcgtctggccggtgggaagccgggaactccagccccctgtaggagaggagaaaggagcgaggcaggagaggaaaacaagtgcaaagtgcattcttgaagcactctgtcaaatcacttttcatgcttcattgagtagaaacatggcacattttccaaagccatcagcctgtcttgttcatattatatcccagacagacacgcaagtattgtaatcattgataaaaatctcattaggcttctggaaaatagatcatgatacatggtgatggcttgcagagtcgtaaacaaaagaagacacatgggacttcaacaactttcatcattcgcggaaacaggaagaactttcctaggcccactaaaatcatccaaatttattatagatgaagaatgtcatgaaagtgtattaatcagttcaacagtaaggcttcttgaaagtttggatttaaccagtgcagtgggacaacttctcaatgaagcagttcaagcacaaaacaacacatatagaactggaatcagtactcttttgtttcttgttggtgcttggagcagtgcagttgaagaatgtcttcatcttggtgtccccatttccataatagtatcagtaatgtcagaaggcttaaacttttgtagtgaagaggtagtttctcttcatgtacctgttcacaatatatttgactgtatggacagcacaaaaacattttctcaacttgaaacatttagtgtaagtttgtgtccttttctacaggtcccttcagatactgatttgatagaggaattgcatggtctcaaagatgttgcctctcaaacactgaccatttccaacctttctgggagacctcttaaatcatatgaattatttaaacctcagacaaaggttgaagcagataacaacacatcacgaactctgaaaaacagcctgcttgcagatacctgctgcagacagtcaatactaatccacagtaggcattttaataggacagataatactgaaggggtaagcaaaccagatggatttcaagaacatgttacagctactcacaaaacttacagatgtaatgatttggtagagttggcagtaggcttgagtcatggagatcacagcagcatgaagttagtagaagaagcagtacagctgcaatatcagaatgcttgtgtgcaacaaggcaactgtacaaaaccatttatgtttgacatttcaagaattttcacttgctgtctaccaggcttacctgaaacttcttcttgtgtttgtccaggatatatcactgttgtgtcagtatctaataatcctgtgatcaaggaattgcagaatcagcctgtgcgaatagttctcattgagggtgacctcacagagaattaccgccacctgggatttaataagtctgcaaatattaaaacagtattagatagcatgcggcttcaagaagacagctcagaagaactgtgggcaaatcacgtgttacaggtgttaatccagttcaaggtgaaccttgtcctggtacaaggaaatgtgtccgaacgcttaattgaaaaatgtataaacagtaagcggttggtaatcggctcagtgaatggcagtgtgatgcaggcttttgcagaggctgcaggagcagtacaggtggcctacattacacaagtgaatgaagattgtgtgggcgacggggtctgcgtgaccttctggagaagcagccctttggatgttgtagataggaacaacagaatcgcaatcttattaaaaacagaaggaattaatttggttacggccgtgctcactaacccagttactgcacagatgcaaatcaaagaagataggttctggacatgtgcctatcgtttgtattatgctctaaaagaggaaaaggtcttccttggaggtggtgcagttgaatttttgtgtcttagctgtcttcatattcttgcagagcaatctctgaaaaaagaaaaccatgcctgctcagggtggctgcataatacttcctcttggctggcttcatctctggcaatatacagaccaactgtgcttaaattcctggcaaatggatggcagaaatacctttcaactctcctatataacactgccaattactcatcagaatttgaagccagcacatacattcaacatcatctgcaaaatgccacagactctggctctccttcatcttacatcttgaatgaatatagtaaactaaatagtagaatttttaattcagacatttcaaataaactggagcagattccgagagtttatgacgttgttacaccaaagattgaggcgtggcgccgagcattggatttagtattgttagtacttcagacagacagtgaaataattactggacatggacacacacagataaattcacaggaattaacgggctttctatttttgtagtgttactggctaagtctttggaaaataatttttcataatatgtcatgctaataataaatatattgatagccaagtcatggtgcctaaaatgccagctattgccaagaagaaaatagttgatgtctgtcaataactgtgcatggtctgagattttaccctacttataagctaacaagttagcctgttactgtttcgtgggatgctacagaatgcataagacacctgggtcagaaacaaaggacttatcgctcacagcaaaagctgtagccagagcttcatgttggttttattcagttcctcatttttctagttcccacaggaggaacacaaagggcccatgatgaaagcctgcacacagtgggttatgttgtaagcttgggttattaactgcttttatagtaagcaaaaaaatcctggtctttgtccaaagggagttattaccccatacttgaagatagcttagtgtaaacacaagcctaggacatggactaggtaaagacaaagtccttgcattcttgacatacccagtaagtatgcagggacactcagagcccatagtggatagtctcttccaacagtctgctcctcagcctgagatgttcttggccaaacttgaattttcacatgagtatgccactctatcagctactctgattaacctgacagtcgggttgtttagtcagtaccaaatttgttcatttggtctcatatagcaattaatgcaggctattatcagacacagcagcaggatgaagccaacctgcagtattaacctcagtcctgtcccccaaggtcttgactcaatcaactctaagttccaagggaggaccaataggtctttttattaggcagccagaatgtagtgaaggacaatttattatactttatgacccaataaagggagctttgactgacgt

SEQ ID NO: 110703 - DNA, 2963 bp, Homo sapiens
  Payload ID: 1708
  Gene Symbol: BBS2
  Gene Name: Bardet-Biedl syndrome 2
  Uniprot ID: Q9BXC9
  ENST ID: ENST00000245157
  CDS Start-End: 422-2587
tgtcaagtttgcagggtgcagcttggatgtggtgctagaaggggaagcctctgggctgagcatgtaggctcgtcagtagagttcaacccgcaggagtaaattactgcagtgggaaacaaccgcacccgcggcccagcaggggttccactgcgcagccgcaaaaggcgccgaggctccactgcgcagccacagaaggcgccgaggctccaccgcgcagccgcaaaaagagcggacgggtctgcgccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaa

SEQ ID NO: 110704 - DNA, 588 bp, Homo sapiens
  Payload ID: 1708
  Gene Symbol: BBS2
  Gene Name: Bardet-Biedl syndrome 2
  ENST ID: ENST00000561877
  CDS Start-End: 1-229
caacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagaggcagtaaaactagaaagaaggagaactcttccctcaagaatggctgtaccttcatatctagaggcacattaaaaaaaagaacgtctgtaccttaaaaatggaggtcatttcattgtgttcattttcaaggttgttgtatggctcggtcagaactttctgttaccagaagacactcacattcagaatgctccatttcaagtgtgtttcacatctttacggaatggcggccacctgcatataaaaataaaacttagtggagagatcactataaatactgatgatattgatttggctggtgatatcatccagtcaatggcatcattttttgctattgaagaccttcaagtagaagcggattttcctgtc

SEQ ID NO: 110705 - DNA, 865 bp, Homo sapiens
  Payload ID: 1708
  Gene Symbol: BBS2
  Gene Name: Bardet-Biedl syndrome 2
  ENST ID: ENST00000562012
  CDS Start-End: 1-360
gatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccct

SEQ ID NO: 110706 - DNA, 2623 bp, Homo sapiens
  Payload ID: 1708
  Gene Symbol: BBS2
  Gene Name: Bardet-Biedl syndrome 2
  ENST ID: ENST00000568104
  CDS Start-End: 180-2207
gccgccgcaggaggagcaggcggtacctggacgggttcgtcccgggctgtttcgcgtccggcctgaggcggctggggccgcgcaggtagtgtccctgcacttcttgcccgggcgcgtgaggccagctccgctgcgcttgtctccagcttccagccctcctcccctaagccgccgccatcatgctgctgcctgtgttcaccctgaaactgcgccacaaaatcagcccccgaatggtggccatagggcgctacgacgggactcacccgtgcctggcggccgccacccaaacgggcaaggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagagatagtcacctctctttgtcccatgtatggcagtcgatttggttatgccctttccaatggcacagttggagtttatgacaaaacatcccgatactggagaattaaatcgaaaaatcatgccatgagcattcatgcttttgaccttaattctgatggagtgaatgaactgataactggttggtccaatgggaaggttgatgctcgaagtgaccgaactggggaggtcatctttaaggacaatttttcttctgcaattgccggtgtggtagagggagattaccggatggatggccacatacagttaatctgctgctcagtggatggggaaatccggggctacctgcctggcacggctgagatgaggggcaacctcatggacaccagtgcagagcaggacctgatccgagagctgagtcagaagaagcagaatctgttgctggaactccgtaactatgaggaaaatgccaaggctgaattggccagtccactgaacgaggctgatgggcatcggggcataatcccagccaataccaggctccacaccacgctctcagtcagcctggggaatgagacccaaactgctcatacagaattacgcatttccacttctaatgacaccatcatccgagcagtattgatttttgcagaaggaatttttacaggtgaaagccacgtggtacatcccagcattcacaacctctccagttccatctgcatccctattgtgcctcccaaagatgtccctgtggatctgcacttgaaggcattcgtgggttacagaagcagcacccagtttcatgtatttgaatcgacaagacagctccctcgattctccatgtatgcgctgaccagcctggaccctgccagtgagccaatcagttatgttaactttaccattgcagaacgggcacagagggttgttgtatggctcggtcagaactttctgttaccagaagacactcacattcagaatgctccatttcaagtgtgtttcacatctttacggaatggcggccacctgcatataaaaataaaacttagtggagaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggtgaggaaaatacaggtcatgaagttcctggcaaagattttctgttaaaaacctatgctggtttgctttggatcacaccctggtgaaccccgggtgctaagaatgaaaataaccttggtgagttgtacaaattaaagacaaagaactacatgtgaagatagacttgctttctatttttaaatcagtagtagtactgttgctgaataatactaggtttttatggaataggatgaatgcttttgaagtattagggcttcagagtccaattttgcttatttatggtatataaatacatatttttttcttgaaattgcaattgagtttgtacttttcaaatagattatctactttttcattaaaatgtaaagatgttaaactttgtgttgattgattataaaatcaccaccaaatcagaa

SEQ ID NO: 110707 - DNA, 564 bp, Homo sapiens
  Payload ID: 1708
  Gene Symbol: BBS2
  Gene Name: Bardet-Biedl syndrome 2
  ENST ID: ENST00000569941
  CDS Start-End: 550-564
actgggggaaagtctgactcctgagatccttgttgctcttgacaaaaattgcaaactctttccattccggtttttattcataatcctcatacacggaaccagcatgtcagtgcatccagggtcttccagagccccctggaatctgatgtttctcttctcagcattaaccaggcagtcagctgtctgactgcaggcgtattgaaccctgagcttggctatgatgcccttttagtggggacacagactaatcttttggcttatgatgtctacaataattcggatttgttctacagagaggtagcagatggggcaaatgcaattgtgctggggacattgggagacatttcttcccctcttgcgattattggtggcaattgtgctctgcaaggtttcaatcatgaaggaagtgatctcttttggacggttactggagacaatgttaattccttggccttgtgtgactttgatggtgatggaaagaaagagcttcttgttggatctgaggattttgatatccgagtttttaaggaagatgagattgtggcagaaatgacagaaacagag

SEQ ID NO: 110708 - DNA, 395 bp, Homo sapiens
  Payload ID: 1708
  Gene Symbol: BBS2
  Gene Name: Bardet-Biedl syndrome 2
  ENST ID: ENST00000564123
  CDS Start-End: 1-256
gaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctagtctttacctggtgaaaggacacaggagatacttcaaagaaaaccagtttgttccacgaagggataagagacttgacaatctgcttcggctgaaagtgttctgcaccaggaaagaacacatcaataaattatcattaacc

SEQ ID NO: 110709 - DNA, 641 bp, Homo sapiens
  Payload ID: 1708
  Gene Symbol: BBS2
  Gene Name: Bardet-Biedl syndrome 2
  ENST ID: ENST00000564459
  CDS Start-End: 1-429
cttcaagtagaagcggattttcctgtctattttgaggaattacgaaaggtgctagttaaggtggatgaatatcattcagtgcatcagaagctcagtgctgatatggctgatcattctaatttgatccgaagtttgctggtcggagctgaggatgctcgtctgatgagggacatgaaaacaatgaagagtcgttatatggaactctatgaccttaatagagacttgctaaatggatataaaattcgctgtaacaatcacacagagctgttgggaaacctcaaagcagtaaatcaagcaattcaaagagcaggtcgtctgcgggttggaaaaccaaagaaccaggtgatcactgcttgtcgggatgcaattcgaagcaataacatcaacacactgttcaaaatcatgcgagtggggacagcttcttcctaggggccaagaaatgaagcttcaggcctgtgaagttggagagcagcaagaatagtgcctcagagcgaaataacttcatgcactccttcaatatctcaggaagcttactctcctcagctttctcataaaacctgaaaaacagcaatgtcaagttgttcatcaaagccacagatgtaaaatgactcacagaataaaagctgatcgttagctttgta

SEQ ID NO: 110710 - DNA, 2490 bp, Homo sapiens
  Payload ID: 1709
  Gene Symbol: BBS4
  Gene Name: Bardet-Biedl syndrome 4
  Uniprot ID: Q96RK4
  ENST ID: ENST00000268057
  CDS Start-End: 42-1601
aaccgccgacttccggccgcgcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatga

SEQ ID NO: 110711 - DNA, 2450 bp, Homo sapiens
  Payload ID: 1709
  Gene Symbol: BBS4
  Gene Name: Bardet-Biedl syndrome 4
  Uniprot ID: Q96RK4
  ENST ID: ENST00000395205
  CDS Start-End: 519-1562
gtctgggaaaccgccgacttccggccgcgcagcggtgggctgagctaaaatggctgaggagagagtcgcgacgctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatacatttaaaagaaaaaaaacaaaagccctggaagttgaggccaagcctgctgagtattgcagctgcatttgcccaaagggaatccagaacaagtccctccctgtattttgttcttgagaggggtcagtctagaagctagatcctatcaggatgaggagcagcagcccagggcttgtctggatcagcaccaacgattttaaagaaaaaaggaagagtttcttagatgagtaattgttattgaagatagtcagtgataaccactgaccagatgctatcaatacactatgtgtcctttttagaataaagattacatatcatcattcctttggggaaaattgttattcaggtataaaaacaagagatcataataaaaacctaaaagaacctatg

SEQ ID NO: 110712 - DNA, 1864 bp, Homo sapiens
  Payload ID: 1709
  Gene Symbol: BBS4
  Gene Name: Bardet-Biedl syndrome 4
  ENST ID: ENST00000562084
  CDS Start-End: 9-242
gagctaaaatggctgaggagagagtcgcgacggtgagcgccgagattctctttagttgcccggccgcagggcaaggcaagctggcgggtggcttttgtcccatgcagcggttcctggagagaggcggagctgggtgccgagcgtctcagggtgggcggggcgacacggtcccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaagagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaac

SEQ ID NO: 110713 - DNA, 681 bp, Homo sapiens
  Payload ID: 1709
  Gene Symbol: BBS4
  Gene Name: Bardet-Biedl syndrome 4
  ENST ID: ENST00000565160
  CDS Start-End: 35-463
gacttccggccgcgcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacag

SEQ ID NO: 110714 - DNA, 551 bp, Homo sapiens
  Payload ID: 1709
  Gene Symbol: BBS4
  Gene Name: Bardet-Biedl syndrome 4
  ENST ID: ENST00000566829
  CDS Start-End: 128-551
ccctttttactgtcccgggaactggtcgcctggggcaagtctggatacttagcagcacaggtcctgttctaggactgtagtccctcttggggtgcgctggacggagaagggagacttttcaccagtaatggctcttaccgtagtgccatctttttctgtctcgggggtttggaagagaactcaatttcctgtatctactgagtctcaaaaaccccggcagaaaaaagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggg

SEQ ID NO: 110715 - DNA, 563 bp, Homo sapiens
  Payload ID: 1709
  Gene Symbol: BBS4
  Gene Name: Bardet-Biedl syndrome 4
  ENST ID: ENST00000566938
  CDS Start-End: 22-84
gcagcggtgggctgagctaaaatggctgaggagagagtcgcgacgctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagt

SEQ ID NO: 110716 - DNA, 1876 bp, Homo sapiens
  Payload ID: 1709
  Gene Symbol: BBS4
  Gene Name: Bardet-Biedl syndrome 4
  ENST ID: ENST00000567279
  CDS Start-End: 22-225
gcagcggtgggctgagctaaaatggctgaggagagagtcgcgacgagaactcaatttcctgtatctactgagtctcaaaaaccccggcagaaaaaagggggagttggagtgagcaatgatttggaataccagaaattcaacttatatatttacagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctt

SEQ ID NO: 110717 - DNA, 843 bp, Homo sapiens
  Payload ID: 1709
  Gene Symbol: BBS4
  Gene Name: Bardet-Biedl syndrome 4
  ENST ID: ENST00000569338
  CDS Start-End: 1-843
gagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctg

SEQ ID NO: 110718 - DNA, 2055 bp, Homo sapiens
  Payload ID: 1709
  Gene Symbol: BBS4
  Gene Name: Bardet-Biedl syndrome 4
  ENST ID: ENST00000566400
  CDS Start-End: 43-105
aaaccgccgacttccggccgcgcagcggtgggctgagctaaaatggctgaggagagagtcgcgacgctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcggccatcagctgcctgaaacgagccaactacttggcaccctttgattggaagattctgtataatttgggccttgtccatttgaccatgcagcagtatgcatcagcttttcattttctcagtgcggccatcaacttccagccaaagatgggggagctctacatgctcttggcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctctggagccagagcctgcggtggaatcaagtccaactgaaacatcagaacaaataagagagaaataagaatagaatgaatgaccccaaaatagggttttcttgggcgaggatgtgctggattaggaaaggtgacatgacacaggcagagcagagtggcacccaccacagaatacagtgtgtgttattacgaggagccagcagttgagcctaaggtccttctacctacctggtattggcatttgaggtcggaaaccctctactgccccataagccaggaaaagtgaaaagagaacacagttcctttaagaactggcagcaaggcttgaggccttatgtatgtagctgagtcagcaaggtacatgatgctgtctgctttcaaaaggacttttctctcctagctgactgactccttccttagttcaaggaacagctgagacagacctctgctgagtagctctgtgatgacaaagccttggtttaactgaggtgatcctcaggttgtgaggtttattagtccccaaggcaaacacaaatattagattaataatccaactttaatagtatac

SEQ ID NO: 110719 - DNA, 541 bp, Homo sapiens
  Payload ID: 1709
  Gene Symbol: BBS4
  Gene Name: Bardet-Biedl syndrome 4
  ENST ID: ENST00000566197
  CDS Start-End: 1-541
tcaacttccagccaaagatgggggagctctacatgctcttggcagctgagctctccagctgcagtgctttctttgttgcagtggctctgaccaatctggaagatatagaaaatgccaagagagcctacgcagaagcagtccacctggataagtgtaaccctttagtaaacctgaactatgctgtgctgctgtacaaccagggcgagaagaagaacgccctggcccaatatcaggagatggagaagaaagtcagcctactcaaggacaatagctctctggaatttgactctgagatggtggagatggctcagaagttgggagctgctctccaggttggggaggcactggtctggaccaaaccagttaaagatcccaaatcaaagcaccagaccacttcaaccagcaaacctgccagtttccagcagcctctgggctctaatcaagctctaggacaggcaatgtcttcagcagctgcatacaggacgctcccctcaggtgctggaggaacatcccagttcacaaagcccccatctcttcctct

SEQ ID NO: 110720 - DNA, 557 bp, Homo sapiens
  Payload ID: 1709
  Gene Symbol: BBS4
  Gene Name: Bardet-Biedl syndrome 4
  ENST ID: ENST00000563600
  CDS Start-End: 22-174
gcagcggtgggctgagctaaaatggctgaggagagagtcgcgacggactgtagtccctcttggggtgcgctggacggagaagggagacttttcaccagtaatggctcttaccgtagtgccatctttttctgtctcgggggtttggaagagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattgggagatcagccataacctaggagtttgct

SEQ ID NO: 110721 - DNA, 777 bp, Homo sapiens
  Payload ID: 1709
  Gene Symbol: BBS4
  Gene Name: Bardet-Biedl syndrome 4
  ENST ID: ENST00000561914
  CDS Start-End: 25-336
cgcgcagcggtgggctgagctaaaatggctgaggagagagtcgcgacgagaactcaatttcctgtatctactgagtctcaaaaaccccggcagaaaaaagctccagagtttcctattttggagaagcagaactggttgattcatcttcattatatccggaaagattatgaagcctgcaaggctgttatcaaagaacagcttcaagagactcagggattgtgtgaatatgctatctatgtccaagatttcttttgggaaaacataaagctgccattgaagtatataatgaagcagctaaactcaaccagaaagattgggagatcagccataacctaggagtttgctacatatacctgaagcagttcaacaaggcacaagaccagttgcacaatgccctgaatcttaataggcacgatctgacttatataatgctggggaagatccacttgctggagggagacttggacaaggccattgaagtctacaagaaagcagtggagttctcaccagaaaatacagagcttcttacaactttaggattactctacttacagctcggcatttaccagaaggcatttgaacatcttggcaatgcactgacttatgaccctaccaactacaaggccatcttggcagcaggcagcatgatgcagacccacggggactttgatgttgccctcaccaaatacagagttgtggcttgtgctgttccagaaagtcctccactctggaataacattggaatgtgtttctttggcaagaagaaatatgtggcgg

SEQ ID NO: 110722 - DNA, 579 bp, Homo sapiens
  Payload ID: 1709
  Gene Symbol: BBS4
  Gene Name: Bardet-Biedl syndrome 4
  ENST ID: ENST00000569440
  CDS Start-End: 22-123
gcagcggtgggctgagctaaaatggctgaggagagagtcgcgacgagaactcaatttcctgtatctactgagtctcaaaaaccccggcagaaaaaaggtgactttcttctggctttcagttgaagatcttacccatcattgagctccagagtttcctattttggagaagcagaactggttgattcatcttcattatatccggaaagattatgaagcctgcaaggctgttatcaaagaacagcttcaagagactcagggattgtgtgaatatgctatctatgtccaagcattgatatttcgcctagaaggaaatatccaagaatccctagaactcttccagacatgtgcagttcttagtcctcagagtgctgataacctcaagcaggtggccagatctttatttcttttgggaaaacataaagctgccattgaagtatataatgaagcagctaaactcaaccagaaagattggcctaggagatcagccataacctaggagtttgctacatatacctgaagcagttcaacaaggcacaagaccagttgcacaatgccctgaatcttaataggcacgatctg

SEQ ID NO: 110723 - DNA, 3475 bp, Homo sapiens
  Payload ID: 1710
  Gene Symbol: BBS5
  Gene Name: Bardet-Biedl syndrome 5
  Uniprot ID: Q8N3I7
  ENST ID: ENST00000295240
  CDS Start-End: 377-1402
aaactgcagggattacaggcagaagccaccatgcccggctaataacctgaatctcttgacggtgaagagaaataaggagaggggtaaaatggctaaaggatgtctgtttggaggcaaggaaggtcgcccagaggtcaggcacgctccccttggcggacacagctgggcttctcagagactcctaaatcctgcctcgcatctcaaatcggcttaacgacgcgaaagagctgggcgacgcgcgcgcactctcgcggaagcttgagtctcggcgcccgccgtagacgtcgtgacagaggcggcccgttgccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatttggtttagctcttgtcatagaaagctctcagcagagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccaatggggacgttgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcctggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtgggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtgggggatcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcacca

SEQ ID NO: 110724 - DNA, 3107 bp, Homo sapiens
  Payload ID: 1710
  Gene Symbol: BBS5
  Gene Name: Bardet-Biedl syndrome 5
  Uniprot ID: Q8N3I7
  ENST ID: ENST00000392663
  CDS Start-End: 72-1034
gccttggagccagagagacgcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagaggtagactcttggtaacaaatttaagaattctctggcactctttggcattatcaagagtcaatgtttctgtcggttacaattgcatattgaatattacaacaaggactgctaactctaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattagtggtggatatgttcttggctttaaaatagatcctgtggaaaaactacaagaatcagttaaggaaatcaattcacttcacaaagtctattctgccagtcccatatttggagttgattatgagatggaagaaaagccccagccgctcgaagctctgacagtcgaacaaattcaagatgatgtagaaatagactctgatggtcacacggatgcttttgtggcttattttgctgatggcaataagcaacaagatcgtgaacctgtattttcagaagaactggggcttgcaatagagaaattgaaggatggattcaccctacagggactttgggaagtaatgagttgattgaccttgagttgagatggatttctattaaagatatctctagtttaaagatactagtcacctgccataagtcatggaatagtttttatatttacagcttttatatttaaaacttgtaagagtttttttaatgattgaggaaaaagtcatttagaaaacttcagttttcggccagcgcgtcgagggaggggccagcgacacatggcctagtaaccgtccggccgcggcgctggcttaagccatggctgagggtagctggattcctcaggcccgggcgctcctacagcagtgcctgcacgcccggctgcaaattcgcccagccaatggggacgttgcggcccagtgggtggaggtccaaagaggactggtgatctacgtgtgctttttcaagggagctgataaagaacttcttcccaaaatggccgaagctggactgtactgctgccatctctggctcactgcaacctccctgcctgattctcctgcctcagcctgccgagtgcctgcgattacaggcgcgcgccgccacacctgactggttttcgtatttttttggtggagacggggtttcgctgtgttggccgggctggtctccagctcctaaccgcgagtgatccgccagcctcggcctcccgaggtgccgggattgcagacggagtctggttcacttagtgctcaatggtgcccaggctggagtgcagtggcgtgatctccgctcgctacaacctccacctcccagctgcctgccttggcctcccgaagtgccaagagtgcagcctctgcccggccgccaccccgtctgggaagtgaggagcgtctctgcctggctgcccattgtctgggacgtgagcagcccctctgcctggctgcccagtctggaaagtgaggagcgtctctgcccggccgccatcccatctaggaagtgaggagcgcctcttcccacccgccatcccatctaggaagtgaggagcttctctgcctggccgcccatcgtctgagatgtggggagcacctctgcccggccgcgaccccatttgggaggtgaggagcaactctgcccagccgccccgtctgagaagtgaggagaccctccgcctggcaaccgccccgtctgataagtaaggagcccctctgcccagcagccgccccgtctgagaagtgaggagcccctctgcccagcagccaccctgtctgggaagtgaggagcgtctccgcccggcagccacccagtccgggagggaggtgggggggtcagtcccccgtccggccagccgccccgtccgggaggtgaggggcgcctctgcccagctgcccctactgggaagtgaggagcccctctgccccgccagccaccccgtccgggagggaggtgggggggtcagccccccgcccggccagccgccccgtccgggagggaggtgggggatcagccccccgcccggctagccgccccgtccgggaggcgaggggcgcctctgcccggctgcccctactgggaagtgaggagcccctctgcccggccagccgccccgtccaggagggaggtgggggggtcagccccccgcccggccagccgcccggtccgggagggaggtgggggggtcagccccccgcccggccagccgccccgtccgggaggttaggggcgcctctgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcacca

SEQ ID NO: 110725 - DNA, 583 bp, Homo sapiens
  Payload ID: 1710
  Gene Symbol: BBS5
  Gene Name: Bardet-Biedl syndrome 5
  ENST ID: ENST00000443151
  CDS Start-End: 53-214
gcagctaggcctgcacggctgtggagagatcctgccacgggccttgttcaccatgtcggtgctggatgcgctttgggaggatcgggatgtccgtttcgacctgtccgcgcagcaaatgaaaacaagacctggagaagtccttattgattgtttagattccattgaagacaccaaaggaaataatggagatagagaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttaaattaagaagtgcactaattcagaacaagcaactaagactgttgccacaagaacatgtatatgataaaataaatggagtttggaatttatccagtgatcagggcaatttaggaaccttttttattaccaatgtgagaattgtgtggcatgcaaatatgaatgatagttttaatgtcagtataccatatctgcaaattcgttcaataaagattagagattcaaaatt

SEQ ID NO: 110726 - DNA, 3752 bp, Homo sapiens
  Payload ID: 1711
  Gene Symbol: BBS7
  Gene Name: Bardet-Biedl syndrome 7
  Uniprot ID: Q8IWZ6
  ENST ID: ENST00000264499
  CDS Start-End: 185-2332
gacgtcacgcaggacgccactgccctgtcgccccgcctgtgcagcccaggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataaggtaaagtcccaaagaagtggtctgtttaaatgaaaaatgttaaaagagaattagaagttaactgtgtatgtactttaatttcaaatgcttttttatatctaaaaatatttgagatataatggctttttaaagtaatgcttctatttcttttgacaaattgaactttctaaaactaaaagagtctttttatttttaaaacacaagtagaatgatttaaataggattttaatgaatttttggcaagtggctgttttaatttttaaattgagaagtaatatgtggaaaattaaaatatattcaaatgtattacaaggtacataaacacataaacatgtagaccgctttataggcttcaaaatgtatttttatatattaccttatttgatcttcacaactgttgtaaaatttgtcaaatcatataagaaaactgattctcagtgaaattttgtgattaagaggacatgctaatattttgtaaagctgggaccagaacccaagtactggtacttgctttgtgtcctggttactatgtatgttgccagctagtggaaataacctaccaattgttttttctaggagataggattgatttgcaactgatattccttttgcttggtagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaatggcatacagataatggaaaataagctttatgtttcaagaagggcagactcacgaattttttagaaaacagtgcttcttaatgatatgctattatacttattagttatgtgcaagctttgtatattcttatatttatatataaatataaaaatttgttaaaggcacgtatagttaagagagttttattttaataaggtcatattgtttttactatgtttaaaaaactttacttctgaaaggaacataattatatctaggtcactagaacgtcattgtgttttttgttggttgccacagcttggggaaaaatagaaaaaaattaatgactgtatttgaatattttgtaatgcactgctatttattatatatatcaacagtagttcaaggtgccatcttaaattaattgcatcttcattaggaaaaataaaaagcataaaacacaatttctggttactatgaataaacgcctaaatgttaagatga

SEQ ID NO: 110727 - DNA, 734 bp, Homo sapiens
  Payload ID: 1711
  Gene Symbol: BBS7
  Gene Name: Bardet-Biedl syndrome 7
  ENST ID: ENST00000507814
  CDS Start-End: 1-417
gatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggcatgatcactgatcttttcatagataaatttaagtttaaaggcaccaatgtaaaaactaaagtaccccttctattggaaattctggacagttatgaccaaaatgcattgatttcattcttcgatgcagcatgacatacaaataagtgttttatgactctgctgcagtttgtggaaatgctggacttggctcagtgctataaattgtagccaggaaataagaagagcttacacagagtcgggggatcttaattagacatgctgtaaccagtggagctattcagcgtgcttcaagtgaagagtgcagaaatagtgatgccatcttagattttcctacactagtatcttctagatctctttttatcatatatgacattaaggctacagaagttttgtgcattaatcttaattcatatttattaatttcaagggaatattgaaaggttttaaaa

SEQ ID NO: 110728 - DNA, 2570 bp, Homo sapiens
  Payload ID: 1711
  Gene Symbol: BBS7
  Gene Name: Bardet-Biedl syndrome 7
  Uniprot ID: Q8IWZ6
  ENST ID: ENST00000506636
  CDS Start-End: 138-2156
aggacctaggcgcggtagctggggctggcttttgaggggcgcgggcagccttctgactgggtcggaggcctgcgggcccgaagcctctgtccctcctgttcttgtccggcgctgcttagcccctccgcgtagtcatcatggatctgattttaaaccgaatggattatctgcaggtgggagtaacatctcagaagactatgaagctaattcctgcctcaagacacagagctacacaaaaggtggttattggagatcatgatggggtagttatgtgctttggcatgaagaaaggagaagcagcagcagtgttcaagactttacccgggccgaagattgcaaggctggaactgggaggggttatcaacacacctcaggagaaaatttttattgctgcagcatctgagattagaggcttcacaaaaagaggaaaacagttcctctcctttgaaacaaacctcactgaaagcattaaagctatgcacatatctggctcagacctctttctcagtgcaagttacatctataaccattattgtgactgcaaagaccaacattattacctttctggggataaaatcaatgatgtgatctgccttccagtggaaagattatctcgtatcacacctgtattggcctgccaggacagagtgctcagagttttacagggatctgatgtgatgtatgcagttgaagttcctggaccccctactgtcttagcactacacaatggaaatggcggtgactctggagaagaccttttgtttgggacatcagacggaaaacttgcgcttatacagattactacatccaaaccagtacgcaagtgggaaattcaaaatgagaaaaagagaggaggtattttgtgtattgacagctttgacattgtgggtgatggggttaaagatttacttgttgggagagatgacggaatggtggaagtgtatagttttgataatgcaaatgaacctgttctacgatttgatcagatgttgtctgaaagcgtcacatctatccagggtggttgtgtaggaaaagacagctatgatgaaatcgtggtgtccacatattcaggctgggttacaggtctgacaacagagcccattcataaggaaagtggaccaggagaagaactaaaaattaatcaggagatgcagaataaaatttcttccttacggaatgagttggaacatttgcagtataaggtattgcaggaaagagagaattatcaacagtcttctcaatcaagcaaagcaaaatcagcagtaccttcctttggtataaatgataaatttacactaaataaagatgatgccagttacagccttatcttagaggtacagactgcaatagataatgtcttaatacagagtgatgttccaatagatttacttgatgtggataaaaattctgctgttgttagctttagcagctgtgattctgagtcaaacgacaacttccttcttgccacttatcggtgccaggcagatactacaaggctggaactcaagattcgctcaattgaaggccagtatggcacactacaagcatatgtgactccaagaattcaacccaaaacctgtcaggtccgccagtaccacatcaaacctctttcactccatcaaagaactcactttattgatcatgacagacccatgaatacactgaccctaacaggccagttcagttttgctgaagttcactcctgggtggttttttgtctgcctgaagttccagaaaaacctccagcaggagaatgtgtgacattttactttcagaacacctttctagatacacaacttgaaagtacctacagaaaaggagagggagtttttaaatctgacaacatttctactatctccatcctaaaagatgtgctttctaaagaagctacaaaaaggaaaattaacctcaacatatcatacgagataaatgaagtatcagtcaaacacactttaaagctaatccacccaaagctggagtaccagttgcttttggctaagaaagtgcagttaattgatgctttaaaagaattacagattcatgagggaaatacgaactttctgataccagaatatcactgtattctagaagaggcagatcacctacaggaagaatacaaaaagcaacctgcacatcttgaaagactctatggttagtggaccattctagaataccttgccatatttcttttcaactggctatttcccaaggatcatgtaagagaagctgggcagaaagataaaaagattacatcagtcatgattcatgaaccagtcatgaatcagttgacaacaaatttattgcacagaatatttctgtattttgtcaagctacttttaatatttaattcttttacttgataaaatgcaagtatattaagaaataagtatactgtgatgaattaatctatatatatgaacaaacctggtataaaatgaatgtaatctatgaacctttagagcttagactgtatttcacacaaataattgtcatgttttgttgctattgtgaattataaaaatgcagcatttaaaatttttaaggcaaaatttaataaaggatatacagta

SEQ ID NO: 110729 - DNA, 4027 bp, Homo sapiens
  Payload ID: 1712
  Gene Symbol: BBS9
  Gene Name: Bardet-Biedl syndrome 9
  Uniprot ID: Q3SYG4
  ENST ID: ENST00000242067
  CDS Start-End: 522-3185
acctgcgcagtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 110730 - DNA, 3899 bp, Homo sapiens
  Payload ID: 1712
  Gene Symbol: BBS9
  Gene Name: Bardet-Biedl syndrome 9
  Uniprot ID: Q3SYG4
  ENST ID: ENST00000350941
  CDS Start-End: 514-3057
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgagcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 110731 - DNA, 4004 bp, Homo sapiens
  Payload ID: 1712
  Gene Symbol: BBS9
  Gene Name: Bardet-Biedl syndrome 9
  Uniprot ID: Q3SYG4
  ENST ID: ENST00000355070
  CDS Start-End: 514-3162
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 110732 - DNA, 3914 bp, Homo sapiens
  Payload ID: 1712
  Gene Symbol: BBS9
  Gene Name: Bardet-Biedl syndrome 9
  Uniprot ID: Q3SYG4
  ENST ID: ENST00000396127
  CDS Start-End: 514-3072
agtggcgtccgttgtaagtgctatgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaaggtcacactgcagaacagagtgatattgcaaaaagccaaattatcagtctacgtgcaaccaccattagaattgacttgtgatcagttcacctttgaatttatgaatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataatatcttggattttatttataattagagggatttatgagtgattgctctacattatttcttcaaaggaaaggaaaggaattgaagactttgctactctctggtaagacttgaatgtgattattttataaataaaagaaccactatgaaactttcatgtgatttgttctattaagctaaacgtggaagaagggaagttttctagtattgtatgaaaatgtttaaatattttcaaggaagctagtacattaacatccccttttcattaccccattgggtggcaccttttaaaaatccaggttattaaaggattcacactttattacagttaaaatttaaggtttttatgtgtaagaagtgaaagaaactttgctaatttcaagttcgaattacagttgtgagattgatttatttaaataaaaatatgcctttgccagtt

SEQ ID NO: 110733 - DNA, 1982 bp, Homo sapiens
  Payload ID: 1712
  Gene Symbol: BBS9
  Gene Name: Bardet-Biedl syndrome 9
  ENST ID: ENST00000434373
  CDS Start-End: 1-1363
tgaccttgtcccttctgtcacggtgaaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctggtaagagactggatggccttcacaagcgttagttaagtcagaagcagtgacaatctggtcagtttttgtcataccagagagcattccgcaaagctgcttgttttccaatttcttcattcttccccttagcactggtgcagctgaatttgatcctttgtgtattcctgtcactattcagatcttttctctctctttctctcttactctctttttttccagaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtc

SEQ ID NO: 110734 - DNA, 596 bp, Homo sapiens
  Payload ID: 1712
  Gene Symbol: BBS9
  Gene Name: Bardet-Biedl syndrome 9
  ENST ID: ENST00000442858
  CDS Start-End: 158-596
attttctaatttaagtgaaaccactagtgtcagcagacaaacgtgtgagctgaacttgacatccttttcttcaactgctcccttctcaaatattttcaaactagaggagcctttctaaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttt

SEQ ID NO: 110735 - DNA, 1252 bp, Homo sapiens
  Payload ID: 1712
  Gene Symbol: BBS9
  Gene Name: Bardet-Biedl syndrome 9
  Uniprot ID: Q3SYG4
  ENST ID: ENST00000425508
  CDS Start-End: 60-992
gtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcaattttctttatggaagcatttgttgcctcgatcttccactttagaaaaatgaagtttctccttttctttgggagaggatatatctgaatacttgccttcttggcatttatacattcaaagctcagtgctagattagagctattatttgcatagtcttttggtattgcccacttttggcattaccatattatttgacaattagaaggaatagggaaggaatattacatgactgtaaaagagttggttatattttatgttgacttcaagggttccatttgaactattatgggcaattaaagagttttacatttc

SEQ ID NO: 110736 - DNA, 3705 bp, Homo sapiens
  Payload ID: 1712
  Gene Symbol: BBS9
  Gene Name: Bardet-Biedl syndrome 9
  ENST ID: ENST00000433714
  CDS Start-End: 492-1874
atgacaacagggcgaagatggctcagagttaggctggagaggggaggtgtcccttccgctgcggccgtcgggtttctgctacatcccattcaccgcctcctccatcctttcctcctcggtgtgagcagcaggacttgcatttgttctcgcctgcctagtgtcttccaagggatagatgccgtttcctctgctggtctctgggggtgacggggggcgcaggggagcttcttgggggaatcactccaactctgtggagctggtggtgctgcctggtggggctctctctttgcccgggacgtggaacaactttcagctggaggacgagagggaatagtgaagctaaaggttgcttttctctgcaccgtccgttcttgctccctctgctccatcactgggaccttgtcaggcgttcataaagcaaaatttgccgaacgagggttcgcagaaaggtggggcagagctcatctgacgtggcatcagtgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgttacattctagaaaactttgtgtctactctgtctcaggaaccttgggtaatgtggaacatgggaaccaatgtcagatgaaattgatgtatgaacataatcttcagagaacagcctgcaatatgacctatggatcatttggtggtgtaaaaggtcgagatttaatttgcatccagtctatggatgggatgctgatggtatttgagcaggagagctatgcttttggaagatttctccctggctttcttctgcctggtcctcttgcctacagttcccgtacagattccttccttactgtctcttcctgccaacaagtggaaagttataagtaccaggtacttgcttttgcaacagatgcagataaaaggcaggagactgaacagcaaaaacttggttctggaaaaagactagttgtggattggactctaaatattggagagcaagcccttgacatatgtattgtctctttcaatcagtcggcatcctctgtttttgttcttggtgagagaaactttttttgccttaaggataatggacaaattcgattcatgaagaagcttgattggagcccaagttgttttctgccatattgctcagtttctgaaggaacaataaatactttgattggaaatcataataacatgctgcatatttatcaagatgtgacactgaagtgggccacccaacttccccacattcctgtagcagtaagagtgggctgtttgcatgatttaaagggagtgatagtcactctgagtgatgatggtcacttgcagtgttcatacctggggacagatccttctctgttccaagctccaaacgttcaatctcgagaactaaactatgatgaacttgatgtagaaatgaaagaacttcagaaaatcatcaaagatgttaacaaatcacaaggtgtttggcccatgactgagagagaagatgacttgaacgtttctgtcgtggtttctcctaactttgattcagtttctcaagcgaccgatgttgaggtgggaactgaccttgtcccttctgtcacggtgaagcagccaagatatacaaccatgcaagtttccatcataataaatcctgttaattgagaaaatttttccatccgttccaagtgaatgaagatgtggctaccttgagtatgtgtgcatgatgcgtgaccatctattccaggcaactaggtcacactgcagaacagagtgatattgcaaaaagccaaattatcagtctacgtgcaaccaccattagaattgacttgtgatcagttcacctttgaatttatgacaccagatttgactagaacagtaagcttttctgtttatctgaaaagaagttatacaccatcagaattggaaggaaatgctgttgtttcttattccagaccaacagatcgaaatcctgatggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtgaaaaattagaagaactcttatctgagagagctgtacaatttcgggccattcaacgccggctactagcaagattcaaagataaaactcctgcccctcttcaacacctggacaccttgttagatggaacctacaagcaggtaattgctctagcagatgcagtggaggaaaaccaaggcaatctgttccagtcattcaccaggctgaagagtgccacccatttggtgattctgctgatcgcgctgtggcagaagcttagtgctgaccaggttgctattctggaagcggcatttctgccgctacaagaagacactcaagaattgggctgggaagaaacggtggatgccgccatttcccacctgttgaagacttgcctgtcgaagagttctaaggagcaggctttgaacctcaacagccagctgaacatacccaaagacacaagccaactgaagaaacatatcaccttgctctgcgatagattatccaaaggtggccgtctctgcctaagtaccgatgcagcagccccacagaccatggtcatgccaggtggttgtactacaatcccagagtcagacctagaagaaagatcagtagaacaagactctacagaactgtttaccaaccacagacatctcactgcagagacacccaggcctgaagtttcacccctccaaggagtctcggaataattcaagtagagttgtttggttgagaggaacatccccatctcaaggccgaacctgtgtgaacctcatgccaagcacagatatagggctggcgcaggtgcttcctaaagctcaccttcctggagatgacatgcatagaaagaggggttgggactttttacttcactaggagaacttgtaacaccatggggaagtcagctgaaacttgtcttgttttgccaggaaaggaagtagttgcctttggtcatccatctgctaatagtcacagaatacagtgaaatgacatagttttgggttagattttataatgcaaagattcagatccaaaataatttcataccccattttttcacagaattcttatatagtaaatgtatcaagtttaataaagcatctcattgtcaaataa

SEQ ID NO: 110737 - DNA, 613 bp, Homo sapiens
  Payload ID: 1712
  Gene Symbol: BBS9
  Gene Name: Bardet-Biedl syndrome 9
  ENST ID: ENST00000432983
  CDS Start-End: 321-613
cccacccacacgcaccgaggggagagggcggtcacgcggccgggggggcgtggcctgcccccggagcccaggcaggaggagggtcttccttaaggaactgctgccaggacagggcagaggattgcagtaattatcactctctgctaatgaggaccaggccgtggttcactcgagccccgccccagtagcaatctaattccaaccgcggccctctcagaagtcggtccccgcctttgcgcctcagcctctctggactccagcccccagaagtcggcgcggcacggcgtgacctgcgcagtggcgtccgtttgtgaaagaaaatgtctttatttaaagcccgtgattggtggtctactattctgggagataaagaagaatttgatcaaggctgtttgtgtctggctaatgttgacaatagtggaaatggacaagataaaataattgtgggtagctttatgggatacctaaggatctttagcccccatcctgcaaaaacaggagatggagctcaagccgaagatttgcttctagaagtggatctacgagatccagtacttcaagtggaagtaggaaagtttgtttcaggtaccgaaatgctacatttggctgtgtt

SEQ ID NO: 110738 - DNA, 549 bp, Homo sapiens
  Payload ID: 1712
  Gene Symbol: BBS9
  Gene Name: Bardet-Biedl syndrome 9
  ENST ID: ENST00000627264
  CDS Start-End: 1-549
ttattcagaaagaatcaattgggaaagggcaggcacacagggacagaagttcttctgggttctgggtttcatccaggaccagcagtacggtctttcagccctcaggctgttttaagcctgaaggcattccgcgagttatccaatgtaaatttagacttcccctaaagttaatttgcctaccaggtcagccttcaaaaactgcaagccacaaaattactattgataccaacaaatctccagtcagtcttcttagtctcttcccaggttttgccagtcagtcagatgatgatcaggtgaatgtaatgggttttcacttcttaggaggtgctcgaattactgttcttgcttccaaaacttctcaacgatatcgcattcagagtgaacaatttgaagatctttggctcataaccaatgagcttattcttcgccttcaagaatattttgaaaaacagggagtcaaagattttgcatgttctttttcgggatctataccccttcaagaatattttgagttgattgatcatcattttgagctacggataaatggtg

SEQ ID NO: 110739 - DNA, 2341 bp, Homo sapiens
  Payload ID: 1713
  Gene Symbol: BARHL1
  Gene Name: BarH-like homeobox 1
  Uniprot ID: Q9BZE3
  ENST ID: ENST00000263610
  CDS Start-End: 614-1597
acggtgctgacgggcccccggagcggcgagggcgcggagagaggacctccccggccaggtggagagtcatgagccgcgggcagccgccgccgctctccgcggtgctgatgccgccaggtgcgctcctttccgcccgctgctagcgcggcccgggcccgcagctatctgcggtgctgacctggccaccctcagccaccacttgcctggaagaagcgtgcggtttggatttttaaaacgccattctttatttagattccaacatcctcgcgtttcttctgtgccaagggggccctcgggccgtccgtctccccctttgctctccccaacttggcgcgccctccctcccattcctccctgacactcccaccaccccccctcggctcggcggctcggcgcgatgctgcagaagacgcactgagcccttttggatctaatgcgcagaggaggttggcccagagctcccgggctcccccaaggctgaactccgtccaaggtgcccgcaggctccctgcccgccttccccatgccagcccgcagctaggggcaggggcagcggcggctggggttgggggtgggtggggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtccactgaggcccggaccccggactgcgtctccccagcccccctcggcgtcctctctcgcggccgctctgtccgggagccatccccacccgccgggtgtacatacgcgtctctgccactccccacccccagcctctgccggctcccctaggcaacccctttctccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtcc

SEQ ID NO: 110740 - DNA, 1197 bp, Homo sapiens
  Payload ID: 1713
  Gene Symbol: BARHL1
  Gene Name: BarH-like homeobox 1
  Uniprot ID: Q9BZE3
  ENST ID: ENST00000542090
  CDS Start-End: 53-1036
aggctgaactccgtccaaggagcttttggggaggacaggtcgcagcttggctatggaaggctccaatggctttgggatcgactccattctctcccaccgcgcgggcagccccgcccttcccaagggggaccccttgctcggggactgccgttcgcccctggagctgagtccacgctcagagagcagcagcgactgctcttcgccagcctctccaggaagggactgtttggagacggggaccccacggcctggcggggcatccggcccaggtttggactcccacctgcagcccgggcagctctcagccccggcccagtcgcgcaccgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtataaagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggactaaatggaagcgacagacggccgtcgggttggagctgctggcggaggcaggcaattactcagcgctccagcggatgttcccgtcgccttatttctacccgcagagtctggtttccaacctggaccccggcgcggcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccgcgggctcggcgtggccccttccgcccgcctttctgagggcgcaggttcgacgccctttcccgggagggggccctgcccggccctccctggcgccccagcccagtgccccccgaagggccaaatgccaagtc

SEQ ID NO: 110741 - DNA, 1979 bp, Homo sapiens
  Payload ID: 1714
  Gene Symbol: BARHL2
  Gene Name: BarH-like homeobox 2
  Uniprot ID: Q9NY43
  ENST ID: ENST00000370445
  CDS Start-End: 43-1206
ggcggctgctgaacggcggagtggcgtggacctcatgtagcaatgacaatggaaggggccagcgggtcgagttttggaatagacacgattttgtccagtgccagttcaggcagcccaggcatgatgaatggagatttccgcccgctcggtgaggccaggaccgcggattttaggagtcaggccaccccatctccctgttcggagattgataccgtagggacggcgccttcttctcctatctcagtcaccatggagcccccggagccgcatctggtagcagacgcgacccagcatcatcaccacctccaccacagccagcagccgccgccgccggccgcggccccgacgcaaagtttgcagcctttgccccaacagcagcagccgctgccgccacagcagccgccgccgccgcccccccagcagctgggctcggccgcctcggcccccaggacttccacgtcttcttttttaattaaggacatcttgggcgacagcaaacctctggcggcatgtgcaccctacagcaccagcgtatcctctccccaccacaccccgaagcaggagagcaacgcagtgcacgagagcttcaggccaaagctcgagcaggaggacagcaagaccaaactcgacaagcgggaggattcccagagcgacatcaaatgccacgggacaaaggaggaaggagaccgggagattacgagtagccgtgagagtccccctgtgagagccaagaagcctcgaaaagcaaggacagctttttccgaccaccagctcaatcaactggagcgtagctttgagcggcagaagtacctgagcgtgcaggatcgcatggacctggctgcagcgctcaacctcactgacacccaagtcaagacctggtaccagaaccgcaggaccaagtggaagcggcagacagcggtgggcctggagttgctggccgaggcagggaactactcggcgctgcagaggatgtttccatcgccttatttctatcacccaagcctgctgggcagcatggacagcactacggcggcggcggctgccgctgccatgtacagcagcatgtaccggactcctccagcaccccatccccagctgcagcggcccctggtgccccgtgtgctcatccacggcctagggcctgggggacagccagcccttaatccattgtccagccccatcccaggcaccccacacccccggtgaaaacattgcagcgaaggcactgcaatcccttccccatatccctgcccaacccggactgctgcccgtcctctccctgctccaggccactaggcctcccttgcagccaactctggaaggcagaggagtaagagaggaagatgcttaccagtgggcaggggacccccaaagaggagccagccctctgctctccatctccccacccctagaaacagggctggaaatctcccccacagcagtgtgactggtgaaaatgctgaccccacacagagtgcaaccagtaagtgaaaacatcaacaaaaacaaaacctcaaattctttttcaaaaatgactttagggacaagcaggagggagggaggggggagggctaaggagggaagaaagaagggcacggagcggaaacagcacaggcagagtgaactatatatggacagcctcaagtgctgaggcaaagggcgttgccgaggacattccgtctgccccagagaaaagaggagggtaactgagaactttgcactgatttctcatgaccttttttcttttggaaaagtggcatgctccataatatgaaaaaaatgtacatttgaaagactgagtgataagtgatatatcatatttattatatgttgtccaaaaagagtcacttatatacgttagtaaaaacatgatttttcttttcatgtcttttcgattcagtaaaataaatgcttagacaaaaatatagatttttttgtgattgaaaattacaaaaataaagtttatctttttttaacaa

SEQ ID NO: 110742 - DNA, 1155 bp, Homo sapiens
  Payload ID: 1715
  Gene Symbol: BANF1
  Gene Name: barrier to autointegration factor 1
  Uniprot ID: O75531
  ENST ID: ENST00000312175
  CDS Start-End: 509-778
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcatga

SEQ ID NO: 110743 - DNA, 946 bp, Homo sapiens
  Payload ID: 1715
  Gene Symbol: BANF1
  Gene Name: barrier to autointegration factor 1
  Uniprot ID: O75531
  ENST ID: ENST00000445560
  CDS Start-End: 303-572
gtcaagcctaagtccttgagttccgggtccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttca

SEQ ID NO: 110744 - DNA, 586 bp, Homo sapiens
  Payload ID: 1715
  Gene Symbol: BANF1
  Gene Name: barrier to autointegration factor 1
  ENST ID: ENST00000530204
  CDS Start-End: 502-586
ccgggcagcagagaaaggaagtcctctccctggaggcctatctccctcagaactgcgcgagaagcgagaccttagaaggcagggcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaataattaagcctgatcaagatgacaacctcccaaaagcaccgagacttcgtggcagagcccatgggggagaagccagtggggagcctggctgggattggtgaag

SEQ ID NO: 110745 - DNA, 670 bp, Homo sapiens
  Payload ID: 1715
  Gene Symbol: BANF1
  Gene Name: barrier to autointegration factor 1
  Uniprot ID: O75531
  ENST ID: ENST00000527348
  CDS Start-End: 275-544
gaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccgggg

SEQ ID NO: 110746 - DNA, 1135 bp, Homo sapiens
  Payload ID: 1715
  Gene Symbol: BANF1
  Gene Name: barrier to autointegration factor 1
  Uniprot ID: O75531
  ENST ID: ENST00000533166
  CDS Start-End: 507-776
gccgcggagcagggccctgattggaggccagaggggttgcggggagaaggggaggagaggggtcgcaggcgctgtggcgggccctgggggagagcttggccgcgctgcggggagggggcggggtgcagcgcgtgggagccgggccgcgggaaggggcgggccgcagcggcgcgcggtgggggcggagctggggcgcggcgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaataattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataa

SEQ ID NO: 110747 - DNA, 595 bp, Homo sapiens
  Payload ID: 1716
  Gene Symbol: BANF2
  Gene Name: barrier to autointegration factor 2
  Uniprot ID: Q9H503
  ENST ID: ENST00000246090
  CDS Start-End: 263-535
gggcctaagacataagctgaacctctggcctgcagttccagatccaaggtgactgagacaaactgccagctgccactggcttatcaggagcacctgaatctgctgacacatcaaggccacttttcttaggagccccctgacttccaaaatcagtgcctttggattcatctcttccgggagagttcagtgtcttctgaaatgttacaaaacgtccttcagagcaagaaggcgtacacgaggagctcgactctgtagaaaggagatggacaacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccaccta

SEQ ID NO: 110748 - DNA, 444 bp, Homo sapiens
  Payload ID: 1716
  Gene Symbol: BANF2
  Gene Name: barrier to autointegration factor 2
  Uniprot ID: Q9H503
  ENST ID: ENST00000377805
  CDS Start-End: 112-384
gatttgccccatgggcctaagacataagctgaacctctggcctgcagttccagatccaaggtgactgagacaaactgccagctgccactggcttatcaggagcacctggagatggacaacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgccttctccaccta

SEQ ID NO: 110749 - DNA, 623 bp, Homo sapiens
  Payload ID: 1716
  Gene Symbol: BANF2
  Gene Name: barrier to autointegration factor 2
  ENST ID: ENST00000427254
  CDS Start-End: 498-623
gagactgatttgccccatgggcctaagacataagctgaacctctggcctgcagttccagatccaaggtgactgagacaaactgccagctgccactggcttatcaggagcacctgggctatcttagtttccactgctgcagcctgtggcctggacatttgcccatggttgtgaggtccccatgcatgggacttcttcctcctgactccaggcttcagttcacccatcaggccttaaagcatcttcggccctatcttgccctgaactttttgctgcaaaaaccaagggcactgcctcaagcttatcttcccagccactgtttactgctgctacattgttgcccaagacacttcagaagtgactgttgttgtcatctcctgccaagtcctggaaggcaagccaccaagtcccatgcaccattcccacagcccgacaaccttcctgactctacccactggaatctaaagagtctgcccacttctggatgtttgttcaggagatggacaacatgtctcccaggctgagagccttcctctccgaacccattggagaaaaggatgtctgctgggtggatggcatcagccatgagctcgcgatcaatttggtcaccaaaggtatcaataag

SEQ ID NO: 110750 - DNA, 360 bp, Homo sapiens
  Payload ID: 1716
  Gene Symbol: BANF2
  Gene Name: barrier to autointegration factor 2
  Uniprot ID: Q9H503
  ENST ID: ENST00000545418
  CDS Start-End: 18-311
aagcaaccctgcgctgaatgctgcgaggaacaaaggagatggacaacatgtctcccaggctgagagccttcctctccgaacccattggagaaaaggatgtctgctgggtggatggcatcagccatgagctcgcgatcaatttggtcaccaaaggtatcaataaggcctacatcctgctgggacaattccttctgatgcacaagaatgaagccgagtttcagaggtggctcatttgctgttttggtgccactgagtgtgaggcccagcagacttctcactgcctcaaggagtggtgtgcctgcttcctgtagacacaaacctcattgctgccccccaccaccctctggggaaaatgacgcc

SEQ ID NO: 110751 - DNA, 3472 bp, Homo sapiens
  Payload ID: 1717
  Gene Symbol: BSND
  Gene Name: barttin CLCNK-type chloride channel accessory beta subunit
  Uniprot ID: Q8WZ55
  ENST ID: ENST00000371265
  CDS Start-End: 255-1217
agagggaaggtgagagggcaaggagtaaaggtggctgggtgtgggtccgttgaagcgagccgcctccagccctgttgaactggtgggcccagggactggagcgggattgaaagggatcttgctctcccttgaagccttgagttgcagcgatttcagtgtcttctctccctgtgtaagcctgtctcggtgtttaggctgaactacagccaccccctctcccgggggtgtgcaggccagggactggccaggcagccatggctgacgagaagaccttccggatcggcttcattgtgctggggcttttcctgctggccctcggtacgttcctcatgagccatgatcggccccaggtctacggcaccttctatgccatgggcagcgtcatggtgatcgggggcatcatctggagcatgtgccagtgctaccccaagatcaccttcgtccctgctgactctgactttcaaggcatcctctccccaaaggccatgggcctgctggagaatgggcttgctgccgagatgaagagccccagtccccagccgccctatgtaaggctgtgggaggaagccgcctatgaccagagcctgcctgacttcagccacatccagatgaaagtcatgagctacagtgaggaccaccgctccttgctggcccctgagatggggcagccgaagctgggaaccagtgatggaggagaaggtggccctggcgacgttcaggcctggatggaggctgccgtggtcatccacaagggctcagacgagagtgaaggggaaagacgcctaactcagagctggcccggccccctggcctgtccccagggccctgcccccttggcttccttccaagatgacctggacatggactccagtgaaggcagcagccccaatgcatctccacatgacagggaggaagcttgttccccacaacaggaacctcagggctgcaggtgcccgctggaccgcttccaagactttgccctgattgatgccccaacgttggaggatgagccccaagaggggcagcagtgggaaatagccctgcccaacaactggcagcggtacccaaggacaaaggtggaggagaaggaggcttcggacacaggtggggaggaacctgagaaggaagaggaagacctgtactatgggctgccagatggagccggggacctcctcccggacaaggagctgggttttgagcctgacacccaaggctgagatgtttgtgctccgtagcttctagtctggaactgctgctgacccctgtgtgacatcacagggcctcagtttccctatctgcaaaatgggatgatatggaggttcaatgagatggtggcattttgagaatggtaaagaaatacacagggaggggatgatgactattagtggactcttgtttttccaatagttagtggtctttggccaacctttgaaggcaaaatatgatttgttgaggtttgcagcagctgaagccctcaaaagcattttccaccttcccccaaagctgacctctgagaggaaccttccttggtgctccctctgggcccctgatcctttgtgaaggccagtcaggtttcccattcctattgtgtcttatagtccacttggtagatggcgtgatccgtctttacacagagggagcctcatctcctcctgggccacattcctcctgcagctcccatcgctccttggccaggacccaaaaccttctgtgactgacccctgctgacctcattctctctgctcctccagttccaagcctagcccccctgcccatcttgcggctcacactcttgcccaagctgttctcctccaccaggatgcccttggctcccttttcagcttggcaaattcgtgctcacccttcaaacccctacacagatgacctcccttggaaaggttttcctgatgtcgctgcctcctggaaccaggtggtcttgcctctctgcgctgcctttgggacctgtatatttgtcagtgtggcatggctgcctgcctcccgttgaagggcagcatcttgactttactcaccttgagatcgcctgtgcccagatgggcctttggcctggcccagaatcggtggtcatcaagggtgtacagaactcaccaggacccaggaacctgttgcagataaaatcactctcccccacgttcccaacttttagactcacagccctcttacttcccagcattcaaacttctaaatggcctgtatgtattcacaaagcaggcaaaaagcccccagaggaacaccaccccccacccctgcctctggaatacatttgctttgacttggaattgtaggtgaaattcatcttcctggcctacttcagtttgaatcagttggctagccaggtgcggtggctcatgcctgtaatctgagcattttgggaggctaaagtgggtggatcacttgaggccaggagttggagagcagcctgggcaacatagcgaaaccctatctctactaaaactacaaaaattagctgggcgtggtggtgcacacctgtagtctcagctacttgggaggctgagctggaggatagcttaagcacaggagatggaagttgcagtgagccgagatcgcaccactgcactccggcctgggtgacagagtgagaccctgcctcaaaacaaaacaattggaattggatggcatttagtgagcatctactatatgccagatattgagctgtgatctctaggggtaaagagacatgaactactgacaccgtgcttgccttcagagggctcacaatctagtgagcttgatttctgtgagtgcagagcagaagctgaggtgggaacagagaagtaaaaaatggacacaccagaggcagaagagtgacagcctcccagctgtttggggcagttgagtatggtggggaaatagctcaagctgtctttgcagcccctgaagacatcactgtaccctattgaaccatctcagggtgatgctattgttacgctgatccctgcaacgcttgcctgtgccccagcccaggatcctggcagctgcagagaaaatggcagtaacactacctcaaaccaggaccacgccctcagagcctgcaccctgggccacctgggagtcagagaccttcacctgggctatggggttctgggttgaggctggggttcccggcctagggaagggcttccgggttgaggccgggggtcctggcctagggaaggagatgcccctgtgtgctgggttacaaggtcatggccctgggaacacacttccttttctttctgggtcatttctgcctctgcagtgaaggatgccacagggtacaccctctctgctgtcatgactcaggacaggagttcctggtcacagctgagtcttcggatgaggtgaggggtagcatgctcctgtgctctgttgcctaaggcagggcagcctacaacccacgttagaaacagcgtcagcactaagggctaaaataaaactactttcaacatttaaa

SEQ ID NO: 110752 - DNA, 1533 bp, Homo sapiens
  Payload ID: 1718
  Gene Symbol: BARX1
  Gene Name: BARX homeobox 1
  Uniprot ID: Q9HBU1
  ENST ID: ENST00000253968
  CDS Start-End: 227-991
cggcgtggggagggggcgcagtcccgggttcgaccggccgagccccgcgcgccccgcccgcgccctgcgcctccgcccggccggccggcgggggagggggcatgagccggcgcccgcgcgccgccccgagctgcgggccggcctagagccccgcgcgggccccgcgccggagccaagccgtcgccgccgccgccgccaaaccgcgggcgcagcagtgggcgccgcgatgcagcggccgggggagccgggcgccgcgcgcttcggcccgcccgagggctgcgcggaccaccggccgcaccgctatcgcagcttcatgattgaggagatcctcacggagccacccgggcccaagggcgccgcgcccgcagccgccgctgccgcggcgggcgagctgctgaagttcggcgtgcaggcgctgctggcggcgcggcccttccacagccacctggccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaatcggg

SEQ ID NO: 110753 - DNA, 1323 bp, Homo sapiens
  Payload ID: 1718
  Gene Symbol: BARX1
  Gene Name: BARX homeobox 1
  Uniprot ID: Q9HBU1
  ENST ID: ENST00000401724
  CDS Start-End: 484-786
gcctggggaactccaggacagaacacggacagggtcgaggagatactccctcccaaatctggggaacggcaacgttgaggagggtctccatctgcgccaccggcgccgaccggcagggcgtggaggttttgcgctgggaggcactggccaagcgcgagcacccccgcggcacgtggtgcggcagtccctggggcagaggagcgcggccgtagctcacccgggtcctcattctctttcttcgcagccgtgctgaaggccgagcaggcggcggtgttcaagttcccactggcgccgctgggctgttcagggctgagctctgcgttgctggcggcagggcccgggctgcccggcgccgcgggtgcgccacacctgccgctcgagttgcagctccgcgggaagctggaggcggcaggccctggggagccaggcaccaaagccaagaaggggcgtcggagccgcactgtgttcaccgagctgcagctgatgggcctggagaaacgcttcgagaagcagaagtacctttccacgccggacagaatagatcttgctgagtccctgggcctgagccagttgcaggtgaagacgtggtaccagaatcggaggatgaagtggaagaaaatagtgctgcagggcggcggcctggagtctcccaccaagcccaaggggcggcccaagaagaactcaattccaacgagcgagcagcttactgagcaggagcgcgccaaggatgcagagaaaccggcggaggtgccgggcgagcccagcgacaggagccgcgaggactgagggcggtatacggtgcggggcctgggatgcccgcgccacccgcagccccctcactcggcggaaacccgcgagccggcccttccgcgtccaagaagtttacttcctaagcctttttattatgatcttgaatgcggacaattggggccaaacgaggaaggacacagacccaaaagccagacccaggtcccagcgcgcttctgggctctaacctgggagactcgcatccagcccggcggaagctacagtctctaccctgagctccgtggcgcagagcgctccacgcgtattcacgccccgctcctcgcctgcacccccaccccgtctggggcctgccctcccggccggggagcctccaggcacacacccgcttctggacgtcggggacccagcggttgggctcaggccacaacggcctgagattgccccggggcaacccgtcggctcggcctggaggccgggtccccgatgtcgctggggcccctaccccctcttgcgaagacggtgactttttttccaataaaatattttatgacacaa

SEQ ID NO: 110754 - DNA, 1813 bp, Homo sapiens
  Payload ID: 1719
  Gene Symbol: BARX2
  Gene Name: BARX homeobox 2
  Uniprot ID: Q9UMQ3
  ENST ID: ENST00000281437
  CDS Start-End: 97-936
ggggcccaggccccgccgtcgcgccagccccgcggccccagcgggccgggcactcgcagccgcgctcgggccggcggacgctcgcgccggctcaccatgcactgccacgccgagctgaggctgagctcgcccggccagctcaaagcagccaggcggcgctacaagactttcatgatcgacgagatcctctccaaggagacctgcgattactttgagaaactttccctctactccgtgtgcccgtcgctggtcgtgcgacccaagcccctgcattcctgtacgggctccccttccctgcgggcatatccgctcctctcggtgatcacccgccagcccactgtcatctcccacctggtccctgccaccccgggaatcgcccaggcactgtcctgccaccaggtcaccgaggcggtctctgctgaggccccagggggcgaggccctagccagcagcgagtcagagacggaacagcccacgccccgacagaagaagccccgccggagtcgcaccatcttcaccgagctgcagctcatgggcctggagaagaaattccagaagcagaagtatttgtcaaccccagacaggttggacttggctcagtctctgggactcactcagctgcaggtgaagacctggtatcagaatcgcaggatgaaatggaagaaaatggttcttaaaggtggacaggaagcacccacaaaacccaaaggtcgccccaagaagaactccatccccacatcagaagagattgaagctgaagagaagatgaacagccaggcccagggtcaggagcagctggagccctctcaggggcaggaggagctctgtgaagcacaggaaccgaaagcacgtgatgtccccttagagatggcagagccaccagacccgccccaggagttgccaataccctcttcggaacccccaccattaagctaaagtaaaacccttttgagggaagagggagactggggagaagggaaaagagagaaggcagggagagtagggagagaaaaccttccagcagcccagtaaactgcgggcgaagagatctacccgtctccctccctcccacagttaccattggccttgtcatcgcaagcatttgacaaagacttgcttgtcttgggcctgtcacctcctgaaaggctgctttagctgtggatgcccttgattaagggagagagcgcctaggagctgcctgccccagctggggtgacggctgtagggctgggtctatgttgcaagccctatatcctagcatgcagtggaaagtgcttagctctctccctcctgacctctgggcagccagtcatcaaagcagagagacgtggcggcatgtgggcagcatgcccaggttccttgctgactcagcacttatttctgtagttttaaaaaagaatttaatgtttttggttgtatttttttgggggggtgagggtgggcaaaaacatgggggtagttctgagttgttagaaatgtttctgaatcaagtttgtttgaagacacgtgtgcctttgtacccattataagatggtcataagacccaagaactgataagctttggttttttttttgttttgttttgttttttgcttcatttacccattcatgcctagggttccattattggaaccctaagcttgtgggagttatttctatcctactgctcaaggtcatcaccaagatctgatttttcataaaaaacatttgtgaccttcggcataaatgggttaaggtgccatccctgaaactgcaatgcagatatgttcagataacttttattttttaattaaaaataaatctttcaaaagga

SEQ ID NO: 110755 - DNA, 3106 bp, Homo sapiens
  Payload ID: 1720
  Gene Symbol: BBOF1
  Gene Name: basal body orientation factor 1
  Uniprot ID: Q8ND07
  ENST ID: ENST00000394009
  CDS Start-End: 124-1713
gcgcgccgtcagcggcgcgggtggggcattgccagctcggcgtcccggttcccttggagacagagctggccagggcggccgcggctgggcaactacgacagcggagcccctggggaagccaagatgccgtcgaagggaaaggacaaaaagaaaggcaagagcaaaggcaaagacacgaagaagttaataaaaacagatgaatctgtggtggacagagccaaggccaatgcctccctttgggaggccaggttggaagtcacagaactctctaggattaagtatcgtgatacttcacggatactggcaaaaagtaatgaggacttaaagaaaaagcaatgtaaaatggagaaagacataatgtcagtattaagttacctgaagaagcaggatcaggagaaagataatatgattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaagcaccgactagaacaagaggctgaaaagaagataataatgctagcagagagagcccaccatgaggctattgtgcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaaggagatcaatgatctgttggttaaggaaaagattatgcaacttgtccagcagagatcacaaatccaaacccttcagaagaaggtagtaaacttggagactgctctgagttacatgaccaaagagtttgagagtgaagttttaaaactgcagcaacacgcaatgatagagaaccaagcaggtcaggtagaaattgacaagctgcagcaccttcttcagatgaaggacagggaaatgaatcgtgtgaagaagctggccaagaacatactggatgagagaacagaagtggaaagattctttttagatgctctgcaccaagtgaagcaacagatcctaattagcaggaagcattataagcagatagcacaagctgctttcaatttaaaaatgagagcagcatgtacaggaagaacagaatatcccaaaatcagaacatttgatggcagagagcacagcaccaatagtgtgaatcaggatcttctggaggccgaaaaatggacacatattgaaggaaatgtggatattggagatttgacctgggagcagaaggaaaaagtattgcgattgctctttgcaaaaatgaatggctgtccttctaggaaatacaaccagagttctaggcctccagttccagactatgttgtttctgacagtggggaaacaaaggaatttggggatgaaagtaagcttcaagataaaatcttcatcacccagcaaattgcaatatcagactcttctggtgaagtggtgctacccactattccaaaagaacctcaggagtctgacacaggaaccttctgagaagcactgattatgacctcacagatgctgctggcagtcccttccttgcagaatccttgctcctgaatatctttaagaaaatttcttaaaggaaaagacaaaaaatttaactcaaaagttacctgtttgccatagaaattggtgtctcccctgaaggaggatcgagagccggtgaatgagaacattggcaaaggcactggaatggggacattcactcccacctaaaacagaacaaatccgtgtcatatcctaaggacaaaggaactctccatttagaaacacaaaggcatcagagaccagttttaaatacccaccttctaccctatcctctaccccatgaactttcattcctgaggaagaaatggggcaatgtgggaggtcatgggggcaatcttaaaccaatgactcaccattatttactgtttcctcttaggaaatagtaaatggatataagaatctcttaaaaattctgttcacgaacctgtccaacatccaccaagtgggcatatttccgagcagtggctccattggtggtgaagatggcagttccatttccatatgggttgttatttacaatctggatggcttcatccaatgtttctgtctccagaaccacaagaactggaccaaaaatctcctctttgtaacaggtcatatttggctgccaggagtgatgcatccagaaaagaagtcagctttttggattctgagtattttatgcttatttggtactttcacttactacacatcatttacgtggacaactttcatattactaatctcttttcatttcaaatcacctatttaaaaaaaaagtcctctctcaagtgtattccgtcttccaagttaccaatcatataaacaacttggaattcctatcaacaataaccacacttcctttaagggactgtatctttagttcatgacccatcatcagctgcctttttaatacctgaacgactagtttcatccaattgttatcaaaaagttacatgaaaatttattttttataaatccaatctatagtaaatataccaggataatttttctctttacagaaaccccatgctgttttctgtaacataaataatccattcttattcactcctttgcctcccaaatatgtctgtatgtttatattttgatatcaggtcgcagacactcaaaacatccttcaccatgcaattaatgtttgttgctgataaacggatttttctgtatggttctgtggcaagagatttcataatttctactgcacttacattcaacacttgatgattcactattatagtaaggatatatgaatttcaaaaaatgcctcataacctcaatttttaagtcatgttagctgagagactttcaaagttttgataaataaaaattgacaagtcaa

SEQ ID NO: 110756 - DNA, 689 bp, Homo sapiens
  Payload ID: 1720
  Gene Symbol: BBOF1
  Gene Name: basal body orientation factor 1
  ENST ID: ENST00000464394
  CDS Start-End: 318-689
tccgcgcgccgtcagcggcgcgggtggggcattgccagctcggcgtcccggttcccttggagacagagctggccagggcggccgcggctgggcaactacgacagcggagcccctggggaagccaagatgccgtcgaagggaaaggacaaaaagaaaggcaagagcaaaggcaaagacacgaaattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaagcaccgactagaacaagaggctgaaaagaagataataatgctagcagagagagcccaccatgaggctattgtgcaattgaacgatgctggaagaaatgtttttaaagagaatgattatcttcagaaagctctggcatatcacctgaaggaaactgacgctctacaaaaaaactcccagaagttgcaagagagtcatactttacttttacatcaaaag

SEQ ID NO: 110757 - DNA, 550 bp, Homo sapiens
  Payload ID: 1720
  Gene Symbol: BBOF1
  Gene Name: basal body orientation factor 1
  ENST ID: ENST00000463558
  CDS Start-End: 223-420
ctacgacagcggagcccctggggaagccaagatgccgtcgaagggaaaggacaaaaagaaaggcaagagcaaaggcaaagacacgaaattgaaaaactgaaacagcaattaaatgaaacaaaggaaaaagcccaagaggagaaggataaattggaacaaaagtataccaggcaaattaatgaactagagggacagttccatcaaaaagccaaagaaattggcatgattcacacagagctgaaagcagtaagacaattccagaagagaaaaatccaagtggagagagagttagatgatctgaaagagaatttaagaaacacagagcggatacatcaggagactcttagaagactggaaagcagattttttgaagaaaaggtacagattattagggttaatttaaaatgttttgtttactagaacataagtgtatttatatgcattctgaaacatcagccttccatttggtatcttaatagaagattagaagattgttaccaaattatagcacaatacaatgagggaaaataaaaccttctagaaatctcaa

SEQ ID NO: 110758 - DNA, 2402 bp, Homo sapiens
  Payload ID: 1721
  Gene Symbol: BCAM
  Gene Name: basal cell adhesion molecule (Lutheran blood group)
  Uniprot ID: P50895
  ENST ID: ENST00000270233
  CDS Start-End: 23-1909
agtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatc

SEQ ID NO: 110759 - DNA, 878 bp, Homo sapiens
  Payload ID: 1721
  Gene Symbol: BCAM
  Gene Name: basal cell adhesion molecule (Lutheran blood group)
  ENST ID: ENST00000591520
  CDS Start-End: 5-878
gaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttgtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggtgacccacccaaggg

SEQ ID NO: 110760 - DNA, 518 bp, Homo sapiens
  Payload ID: 1721
  Gene Symbol: BCAM
  Gene Name: basal cell adhesion molecule (Lutheran blood group)
  ENST ID: ENST00000590196
  CDS Start-End: 1-185
agggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactgatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaa

SEQ ID NO: 110761 - DNA, 2686 bp, Homo sapiens
  Payload ID: 1721
  Gene Symbol: BCAM
  Gene Name: basal cell adhesion molecule (Lutheran blood group)
  ENST ID: ENST00000589651
  CDS Start-End: 55-1821
gccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctc

SEQ ID NO: 110762 - DNA, 3430 bp, Homo sapiens
  Payload ID: 1721
  Gene Symbol: BCAM
  Gene Name: basal cell adhesion molecule (Lutheran blood group)
  ENST ID: ENST00000611077
  CDS Start-End: 67-1833
ctctggctcccagccccgcagcggccgagctgcagcccgggctcagtctccgccgccgccgtgaacatggagcccccggacgcaccggcccaggcgcgcggggccccgcggctgctgttgctcgcagtcctgctggcggcgcacccagatgcccaggcggaggtgcgcttgtctgtacccccgctggtggaggtgatgcgaggaaagtctgtcattctggactgcacccctacgggaacccacgaccattatatgctggaatggttccttaccgaccgctcgggagctcgcccccgcctagcctcggctgagatgcagggctctgagctccaggtcacaatgcacgacacccggggccgcagtcccccataccagctggactcccaggggcgcctggtgctggctgaggcccaggtgggcgacgagcgagactacgtgtgcgtggtgagggcaggggcggcaggcactgctgaggccactgcgcggctcaacgtgtttgcaaagccagaggccactgaggtctcccccaacaaagggacactgtctgtgatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgcgccgcccactacagcctgcccgagggccgccacggccgcctggacagccccaccttccacctcaccctgcactatcccacggagcacgtgcagttctgggtgggcagcccgtccaccccagcaggctgggtacgcgagggtgacactgtccagctgctctgccggggggacggcagccccagcccggagtatacgcttttccgccttcaggatgagcaggaggaagtgctgaatgtgaatctcgaggggaacttgaccctggagggagtgacccggggccagagcgggacctatggctgcagagtggaggattacgacgcggcagatgacgtgcagctctccaagacgctggagctgcgcgtggcctatctggaccccctggagctcagcgaggggaaggtgctttccttacctctaaacagcagtgcagtcgtgaactgctccgtgcacggcctgcccacccctgccctacgctggaccaaggactccactcccctgggcgatggccccatgctgtcgctcagttctatcaccttcgattccaatggcacctacgtatgtgaggcctccctgcccacagtcccggtcctcagccgcacccagaacttcacgctgctggtccaaggctcgccagagctaaagacagcggaaatagagcccaaggcagatggcagctggagggaaggagacgaagtcacactcatctgctctgcccgcggccatccagaccccaaactcagctggagccaattggggggcagccccgcagagccaatccccggacggcagggttgggtgagcagctctctgaccctgaaagtgaccagcgccctgagccgcgatggcatctcctgtgaagcctccaacccccacgggaacaagcgccatgtcttccacttcggcaccgtgagcccccagacctcccaggctggagtggccgtcatggccgtggccgtcagcgtgggcctcctgctcctcgtcgttgctgtcttctactgcgtgagacgcaaagggggcccctgctgccgccagcggcgggagaagggggctccgtgagtggcctgctatctgcaatgaccaccatagcttaaccccatccccaccctcaaccccaagctcaacccataacctcaaccacatcttatcctccaccccacatcccaccacatccacctccatccccaacccatcctcatccccaactacagccccaaacccagccccagactaatccacagccatccccaactcatcctcatccccaactgcagccccaaacccaacccagggccatccccaaacccatccccaagccaaactcaacaccatccccttccctaatcacctctcctgcccctagctcagcctcatccccaactccatgcctgtctccaatcccaaccctgcccccaatctcccctcaactccaatccataacccccttcaaaccatcctcaactaagctcctctccagccctggccacatccccatcctcccccaacctccagccccaacacccatcatccccctgagctcacccttaactccaatttatcctccaagcctatctctcaccatccagccctcacctagccatttcccaaccctagtcctccaccgtcccgaagccaacttcacccatgtccccatccccaatcttgtccccattcctgactccaaatccaacccctaagcctccccaagctcctcctcatctaaccttgtctccagccccaaccacatggccgtcctcacctccaatccgtaaccatcccagaccgatcccaaagccaactccagctacattcccacctccaaccccaatagcatctgcatccccatgcccaaccctaaccccagtgccattaccagcccctaccccatccctatgccatccccacccagcacacccccatcctcacctccatccccagccgcatcctagtcccacccacccccatcctcagttcctccccctgccgtgtgcacctccaacacgacgcctccgcccgctgcctcctccccccaggccgccaggggagccagggctgagccactcggggtcggagcaaccagagcagaccggccttctcatgggaggtgcctccggaggagccaggggtggcagcgggggcttcggagacgagtgctgagccaagaacctcctagaggctgtccctggacctggagctgcaggcatcagagaaccagccctgctcacgccatgcccgcccccgccttccctcttccctcttccctctccctgcccagccctcccttccttcctctgccggcaaggcagggacccacagtggctgcctgcctccgggagggaaggagagggagggtgggtgggtgggagggggccttcctccagggaatgtgactctcccaggccccagaatagctcctggacccaagcccaaggcccagcctgggacaaggctccgagggtcggctggccggagctatttttacctcccgcctcccctgctggtccccccacctgacgtcttgctgcagagtctgacactggattcccccccctcaccccgcccctggtcccactcctgcccccgccctacctccgccccaccccatcatctgtggacactggagtctggaataaatgctgtttgtcacatcaacacc

SEQ ID NO: 110763 - DNA, 1206 bp, Homo sapiens
  Payload ID: 1722
  Gene Symbol: BPY2
  Gene Name: basic charge, Y-linked, 2
  Uniprot ID: O14599
  ENST ID: ENST00000331070
  CDS Start-End: 333-653
aatatctcaggacccaggaccatgtgatatgggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaggcccagatcacagaagtaattgtgccatatgtggaacaagcagctaagcaatagataacatccatcgtggctctgccttcaaagggaaattttacatatgtcactgggaccatcacccagatgatgtcctgcccactaaaagaattgtgacataacgctgactgcaaaaactgggtaatgcaactctcctctttattctggagtctgccaaaacaagggattatcacatattgcggagtccagcacccaggtaaaattttgtcatatacccagcttcagataccatgcaataatacaactatcatacctggacccaaagaggagagatattttgattctcattgccattcttatggccacaagcaaagtaatggttctcatagtggtataaagttcacacagtattatgacactcccagcgtatcatagaaaatgtgagtagtacaatgagtgttataacagggaacagcaaaccaatgctattgtgattattggattcacacccagctgacgcgactatcattctctcacaagaacagaacctgcaaataaagtactaaatctcaccaaaa

SEQ ID NO: 110764 - DNA, 321 bp, Homo sapiens
  Payload ID: 1722
  Gene Symbol: BPY2
  Gene Name: basic charge, Y-linked, 2
  Uniprot ID: O14599
  ENST ID: ENST00000382585
  CDS Start-End: 1-321
atgatgacgcttgtccccagagccaggacacgtgcaggacaggatcattactctcatccctgccccagattttcacaggtgctgcttacagagggcatcatgacatattgcttgacaaagaacctaagtgatgttaatattctgcataggttgctaaaaaatgggaatgtgagaaataccttgcttcagtccaaagtgggcttgctgacatattatgtgaaactgtacccgggtgaagtgactcttctgactaggcccagcatacaaatgagattatgctgtatcactggctcagtgtcgaggcccagatcacagaagtaa

SEQ ID NO: 110765 - DNA, 559 bp, Homo sapiens
  Payload ID: 1722
  Gene Symbol: BPY2
  Gene Name: basic charge, Y-linked, 2
  ENST ID: ENST00000602732
  CDS Start-End: 527-559
atggaacattgtgacatatatgtgggacctgcacccaggtgatgtaactctcttgactgggaccttttctaaggagggcttgcaaatgtctcaggacccaggaccgtgtgatgtggcacttcagcctggattctgcccacctattaaattgtctaggtgatgtgacttcctgcttgaccctgcccacatggagcattgtgacatatgtgtggaacctgcacttagggcccaacacctggatgatgttactcttctgcctaggtcatgcgtaaagagggaattagggcatattgcttggcccagtcccgtaatgatatgactctcctgcttgtgccagagccacagaagtgtgcttggtgacataatctttgaggctgtcacatcaccaagattatattgtatcactggaccagcataaagctgacacttctgactatgcccagccttcaaataatactacactgtataattggctcaacacccaggtgatattgttccatttacctgagaccagataaaaagcctaatgatgacgcttgtccccagagccaggacacgt

SEQ ID NO: 110766 - DNA, 1206 bp, Homo sapiens; identical to SEQ ID NO: 110763
  Payload ID: 1723
  Gene Symbol: BPY2B
  Gene Name: basic charge, Y-linked, 2B
  Uniprot ID: O14599
  ENST ID: ENST00000382392
  CDS Start-End: 333-653

SEQ ID NO: 110767 - DNA, 559 bp, Homo sapiens; identical to SEQ ID NO: 110765
  Payload ID: 1723
  Gene Symbol: BPY2B
  Gene Name: basic charge, Y-linked, 2B
  ENST ID: ENST00000602770
  CDS Start-End: 527-559

SEQ ID NO: 110768 - DNA, 321 bp, Homo sapiens; identical to SEQ ID NO: 110764
  Payload ID: 1723
  Gene Symbol: BPY2B
  Gene Name: basic charge, Y-linked, 2B
  Uniprot ID: O14599
  ENST ID: ENST00000615850
  CDS Start-End: 1-321

SEQ ID NO: 110769 - DNA, 1206 bp, Homo sapiens; identical to SEQ ID NO: 110763
  Payload ID: 1724
  Gene Symbol: BPY2C
  Gene Name: basic charge, Y-linked, 2C
  Uniprot ID: O14599
  ENST ID: ENST00000382287
  CDS Start-End: 333-653

SEQ ID NO: 110770 - DNA, 559 bp, Homo sapiens; identical to SEQ ID NO: 110765
  Payload ID: 1724
  Gene Symbol: BPY2C
  Gene Name: basic charge, Y-linked, 2C
  ENST ID: ENST00000602680
  CDS Start-End: 527-559

SEQ ID NO: 110771 - DNA, 321 bp, Homo sapiens; identical to SEQ ID NO: 110764
  Payload ID: 1724
  Gene Symbol: BPY2C
  Gene Name: basic charge, Y-linked, 2C
  Uniprot ID: O14599
  ENST ID: ENST00000618574
  CDS Start-End: 1-321

SEQ ID NO: 110772 - DNA, 2749 bp, Homo sapiens
  Payload ID: 1725
  Gene Symbol: BHMG1
  Gene Name: basic helix-loop-helix and HMG box domain containing 1
  Uniprot ID: C9JSJ3
  ENST ID: ENST00000457052
  CDS Start-End: 417-2333
agcggctcacgccgaccaaggccttgtcagaaggctcgaggccgagctcacgctgtgcaagacgacagggcccttcccgaggcgcgcgtgcgcacggccacttgcaccctgccctttcaaccccgtcgtctcgtgcccagcacatcttggctggaactggtaggggcgtggcctggcctcaggaacgcactcttgctctgctcctcacgcctcgcgcaggatcctcgcgccgggaggattcgcacccaaccccaagcccggttgggaacgtggtgtccgagaccgtctgggatccccgcgcgcacggccggcttcccgggacccgcgcgagacgctgtctgatcgggctccctagagtggggcccggagaaaccagaacggcgggggcagcctcacgccattttgcacgccctgagatgtttggttccagcagatacttgggttcctctgaacagcccagagctaattcactgggtcccagtgacaggaccttggttttgtgctccctagtggaaggggaagataaggtcaacccctccgaaccacatggactgagaatggaggagaaatggttgctcaaaggaaaactgaggaatcagaggaaccaaaacaagctcctgtccccaaacaagaagcagaggaaaaaccacactagcaagctgcaagagttggcactgctgctgcccatagccctgaagacggggaccaagaagctcacaaagaaggagattctggtgcatgtcctgcagtacattcagtacctccagagaaacatcgatgccgccaaggccttgttcaaatgccacatcaccactggggaaggtggacttgcggggctgggtcagaaaccagcctggggcccagccaggcggaggagacactctaccccctccagctccccaagctctcagaagtcctgtctccagggggcgtgccagaagcctcggaagaagaagctgacccaggcatcagaaagccagactcggaccccgaagcctcgccgctctctggccctgaacaagcctgagaagctggtggccccatccccagaccagaaaggaagtggcacaggggggaccactacccctccaaggtgccctgactcctgcggtcacccgaggcctgcatcatcctcacctccaggtgacagaaaaggaggacagtcccagctgacgctgttggatctggccgaggacaccatccactgtgacatctcaagctgctggtgccagggcagtgtccaggatgacgcacctttccctgcgctcctggctcaggaagatgtggcgaggatccattttctcaacaagacccagccccatcccaggcagaagctggtgttctatgattccagcgaggatgtggacaaagggtccctagacgctgacccttggctccctgcctggaccccagagaacagcccccaagggagcccactgttcctggggcctccccagattgatgtctggagtggaacaggccacccaagtgagatcctcgggctcagccctagccttttcagctccccagggaaactgctgccagacgagatcttggaggatgacatggagtacctgacccaagcggctttctttgaagaagtgtgcttagatctggagtcttcaccttcagcctacacgcaggaggctccacaggaaaaggacacagcctccaaggcccccaaagaccctcctgagtcccacagcctgcaccggtcctcagtctcgctggaccactgctacctctcgctgagcgggaacagcaaggcgccatccagctccagctccagctccagctccagctccagctcggaggacagcgactcggagcccctgtggaagcagcgagaggatatgcaggccaaccctgtgggcacgccgggctccagcgaagaggacgaagacaccacatggacccccacccggctggcctcacccctgctggcagctgagaaaaaggccacgaagggccaagtagccagggcccctgtgaagcccaaggagaagaagaaaggcccctgcccaccccagatgaagaagaagtgtgtcaacggcttcatcatgttctgcaggatgaaccggaagcagtacatccgatcctgccctggaaccgcttccacagctgccaccaaggagctggcccagctgtggcgggtgatgacccagcaggagcggaggccatactgcaccaaggctcgcaggttcagccgccagcacaaccgcatcgtgaagcaggacggctccagcagcgaggctgaggactgggagacgccaaagcccttctaccagctgctggccgagaaggccttgccgctgcccccgcacctccagtgagagggcggcccctcgcctcgctcccctcacccctcatggcaaccgcggctcttgctggaagccaggacccatcgatgaacttgtccctcctgggcctccagcccctgagaatgcaggtcccatgggactggggaggggggcactgattagccccaaccgctgggcacatttgcctggagcaccagagtcacccacagctgccttgattctcccccaggcttaggaaggaaacccaaaatgaaatgcggggtgtcggaaggtgaagtttacccacccctctccccttcccttccccaccccagagccactcggttgcaaccctgttcatgctcacctcaccctactcctccctctcctgttctatttttagactatttattgttttaaataaaataaagcaagtggaacctttgtta

SEQ ID NO: 110773 - DNA, 3974 bp, Homo sapiens
  Payload ID: 1726
  Gene Symbol: BHLHB9
  Gene Name: basic helix-loop-helix domain containing, class B, 9
  Uniprot ID: Q6PI77
  ENST ID: ENST00000361229
  CDS Start-End: 529-2172
gagaggagtgttttcttgcatccagaaaagacctgagaggcggacgacacctgtgctccgcagagcagaacgtgggaggaacggcgggatgttaaggagctcaagaagcagagagtctacctgcccgacgcgttcgtggagaggagcagcggttgctgttggaggaggtgggtgcaaggacggcagatggcatccctgagaggtggtgactgagactagatgcgggtgcaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacata

SEQ ID NO: 110774 - DNA, 5130 bp, Homo sapiens
  Payload ID: 1726
  Gene Symbol: BHLHB9
  Gene Name: basic helix-loop-helix domain containing, class B, 9
  Uniprot ID: Q6PI77
  ENST ID: ENST00000372735
  CDS Start-End: 586-2229
gagaatcgaagtgaggagccgccagaggagagctgaggagaggagggggaggtcgacgacctgggccctgggcctctgaaggaaaggagctgtaacttctattgggaaaatgactgacttcaaagttggcaggaggtgtaatcaggctgcaggtcttggggtgattagggaatcattgaggaagagcagacaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaacatatttttgaatcacttaatatttttcccatgttaacagttggtatatagtgttgtaaacctttattgcatattctcataacatacaatatacacattcttttgcaaaaatgggaacacagtattgagacttgccttttcctcttaacacttatcttttcaatttagtattatatagatctgtcacatgctttttatctaataactttatagaaatataattgccatacattaagctgcatgttgaaagtatacagtgtgatcagttttggaatgtatatacacacaaaaccataaccacaatcaaaattgtaaatacattcatcacccaccaaagctactttttttttgagacagagtcttgctctgtcacccaggctggagtacagtggcgcaatctcggcccactgcaacctctgcttcccaggttcaagtgattctcgtgccttagcctcctgagcagctgggactacaggtgcatgccaccacatccgactaatttttttttttattttttgtatttttagtagagacagggtttcaccatgttggccaggctggtcttgaactcctggtctcaagtgatctacccatcttggtctccctgagtgccaggattacaggcgtgagccaccatgcccagcctcccccaaagcttcttaatgcccttttgtaatccctccctcccctctctccctgtgcccctaacccaggcaaccatgggacattttctgacaaaatagaattgttttcatttcctgtaattgtgtataaatggactcatatagcatgtactctttggtcgggaggggatctggcttatttcacttagtgtaattatttgagattcatccatatcatgtgtctcactatttcattgctttttattgccaagtagtattccaccatatggctttaccacagtttatttatccattcacttattgatggacatttgggctgttcagagtttggccattataagtaaagcagctatgagcatttgtgtacaagtgtttttatggacataggctttcatatctttggaatgacatctaacaatattgaatcttcgacccatgaataaaatctctctccactta

SEQ ID NO: 110775 - DNA, 3936 bp, Homo sapiens
  Payload ID: 1726
  Gene Symbol: BHLHB9
  Gene Name: basic helix-loop-helix domain containing, class B, 9
  Uniprot ID: Q6PI77
  ENST ID: ENST00000448867
  CDS Start-End: 494-2137
acaccctcgcggagagagcggttcttgcagcatcctgcgcagcccctgcccagtttggtgcagaggcgtggggggcgggacgcgtctttgccattctgatagcggggaaagcggtgagaatcgaagtgaggagccgccagaggagagctgaggagaggagggggaggtcgacgacctgggccctgggcctctgaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 110776 - DNA, 4082 bp, Homo sapiens
  Payload ID: 1726
  Gene Symbol: BHLHB9
  Gene Name: basic helix-loop-helix domain containing, class B, 9
  Uniprot ID: Q6PI77
  ENST ID: ENST00000457056
  CDS Start-End: 640-2283
attaggcctgccgagaggagtgttttcttgcatccagaaaagacctgagaggcggacgacacctgtgctccgcagagcagaacgtgggaggaacggcgggatgttaaggtaggagctcaagaagcagagagtctacctgcccgacgcgttcgtggagaggagcagcggttgctgttggaggaggtgggtgcaaggacggcagatggcatccctgagaggtggtgactgagactagatgcgggtgcaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 110777 - DNA, 4031 bp, Homo sapiens
  Payload ID: 1726
  Gene Symbol: BHLHB9
  Gene Name: basic helix-loop-helix domain containing, class B, 9
  Uniprot ID: Q6PI77
  ENST ID: ENST00000447531
  CDS Start-End: 589-2232
acaccctcgcggagagagcggttcttgcagcatcctgcgcagcccctgcccagtttggtgcagaggcgtggggggcgggacgcgtctttgccattctgatagcggggaaagcggtgagaatcgaagtgaggagccgccagaggagagctgaggagaggagggggaggtcgacgacctgggccctgggcctctgaaggtctgtttctttctaggttcctgtagagatctgtatgtagctgttcacttggaagttaattaagaaagaacaaaaactattcatttggattcaaggtccatctccactggtggctgtggtggctttggattgttggaagaccatcaccttcagcaggtctgcacttgggaacaatcattctcccccagcccgagcgtgcctctgccctctgtatcattgacagaggctgtatgtttggaaagagaactttgtgactgcagaactgacagttgactctaattcttgctaccaagtttttccccgacccagtgaaagagtgttaagacttcgacctaggacacattgagaaccaaggccaagactggacagggccatataactgggcttcaaccatggctgggactaagaataagacaagagcccaggccaaaactgaaaaaaaggctgctatacaagctaaagctggagcagagagggaggctactggtgttgttaggcctgtagccaagaccagggccaaagcaaaagccaagacagggtctaagacagatgcagtagcagagatgaaggcagtgtctaagaacaaggttgttgctgagacgaaggaaggagctctgtcagagcctaagactctgggcaaagccatgggagatttcactcccaaggctgggaatgagtccaccagctccacatgtaaaaatgaggctggtactgatgcctggttctgggctggggaagaggccactatcaattcctggttctggaatggagaagaggctggtaatagtttcagcactaagaatgataaacctgaaattggtgcccaggtctgtgctgaggagttggaacctgcggctggggccgattgcaaacctaggtcaggggctgaggaggaggaggaagagaatgttattgggaactggttttgggaaggagatgatactagttttgaccctaatcctaaacctgtgagcaggatagttaagcctcagcctgtgtatgaaattaatgaaaaaaataggcccaaggactggtctgaggtaactatctggcccaatgcccctgctgtaactccagctgtgttaggatttagatcccaggcaccatctgaggcaagccctccttcatatattgttctggcctccgctgaagaaaatgcctgttctttgcctgtggcaacagcttgccgcccttctaggaacactcgctcatgctcacagcctatccctgagtgtcgttttgattctgacccctgcatccagaccatagatgagattagacgtcaaatcaggatcagggaggtaaatgggattaagccatttgcttgtccttgcaaaatggaatgctatatggattctgaggaatttgaaaaacttgttagcttacttaagtcaactactgatcctcttattcataaaatagcacggattgcaatgggtgtccataatgttcacccatttgcccaagagtttattaacgaagtaggtgtagtgacacttattgaaagcttgctcagttttccttcccctgaaatgagaaaaaagactgtaattactctgaatcctccttctggggatgaaagacaacgcaaaattgaattacatgttaagcatatgtgtaaagaaaccatgtcatttcctttgaactcaccgggacagcaatctggattaaagatactaggacaactgactactgattttgtccatcactacattgttgccaattacttttcagagcttttccatttgctgtcctcaggaaattgcaaaaccagaaatcttgttttgaaactacttttaaatatgtctgaaaatccaactgcagccagagacatgatcaatatgaaggcattggcagcattaaaactcatctttaaccagaaagaggcaaaagccaatcttgttagtggtgtggccatatttattaacataaaggagcatatcagaaaaggctcaattgtagttgttgatcacttgagttataatacactcatggccattttcagggaagttaaagagattattgaaacaatgtaaaatgagccagagatagaacattttaagccatcttcaaactctagcaggctgtacattacagtgtacacattatacactgcatctttaacacagagtcacctgtgacaggctctaggtttgagctagactattttgggggtatcaaatgaatattataccttgggctgaaaatgtttgatttttatcttgtctagattggcatatttttaacattttacttaagatagcaaaccagttcgttttaagtaagctaacttgttcattagtatctgtggcttaaaatggcaaaaaagaaaatatccttgagtttgtaatctagttacagaagtaaggcatacacacacacaaagataacagtacctagagagagagtgtgtgtgagtgtgcgtgtctctgtgtgtgcacgtgcacgctcatggccaaatgtgcgcactctacataaaggaggcaggagttcctataggctatttaatgtaagagaaactatttttctcctgttccagctgtatcagatactcgttccgcaacacagaaatgactcagaatctcagacaaaatgtattatttgttcaattttaattttgctactacattcataactcttaaattgttaggctgtttcatttacatcaaagttatctcacaaaagagaaggcaggaaacgttttgtgagtgcctattctatgtcaaacactgtgttggcaccatattttacaagtttttttcctcttctcacagtgatcttgtgagttagttacttatatttttattagaactcattattctgggtaccctccaatgagaattagagaggttaaataccttttcctagattcccacagcaggaaggtggcatagctgttttgtctgacaccagaacccatctcaccacactgctttacagtcttcctgaaggacattttgaggtgggggggccttcaaagctcagagactggtttgaatggtttaattttgcaatggatcatgtccatgccaggtgttacaattcttaacttcctccaaattcgtgtgtccattagacatttggctacatctggctggaggtcaggagaaaattctgaggtaaatagatggattttatctggcagtgtcgaaaatagtaggagcctaaaactttgttcaatgagtaagatgtagatttggagtcatcagcaggggaaacttgttagatgtcctttgtatctttttctatccatttgtattttttctttcccaaagagctgaaatcattttataccctgaatttaaaaggtaattgcttttttcctccttgcgaaatcataccttaattttttttttttttttttttaccatttatgatttattctcctatgtgtcatatgaaaggccaaggggctttatcttttactagtaggcaagcctgggcatttctgcatttgtgccagctaacactacaaaatagacttaattagagaaatttagacccagaattgcagcttcaacaacacaaaacaggaaagctagaagaggttgctgtgtcaacctacaagatagtgattcttggaagttggtatggaccagaaagcattcccaggacatttaggctatggctgagttctctaagactcagggtgggaattataatccctggtctaagctgatatgaaagtttctatgtgtgaaaatatggagttatatgctttgagattttctgccagttaaactaaaacaagatcatactgtaaatgtttgtaacttgcttccccccactgtatactgtaaacatctttgcatgtcaataaatatgcctctacaac

SEQ ID NO: 110778 - DNA, 706 bp, Homo sapiens
  Payload ID: 1727
  Gene Symbol: BHLHA15
  Gene Name: basic helix-loop-helix family, member a15
  Uniprot ID: Q7RTS1
  ENST ID: ENST00000314018
  CDS Start-End: 57-626
agctccaagggcctcaccttcctgccgccacctcctaggacagccagtccagggccatgaagaccaagaaccggcccccacggcgccgggccccggtgcaggacacagaggccacccccggggaggggacgcccgacgggtccctgccgaacccggggccagagccggccaagggtctgcggagccggccggcccgggccgcagcaagggctccgggcgagggcaggcgcaggcggccaggaccctccgggcccggtggccgtcgtgacagcagcatccagcggcggctggagagcaacgagagggagcggcagcggatgcacaagctaaataacgccttccaggccctgcgtgaagtcatcccccacgtgcgcgcggacaagaagctctccaagatcgagacgctcacgctggccaagaactacatcaaatcgctgacggccaccatcctgaccatgtccagcagccgcctcccaggcctggaggggccgggccccaagctctaccagcactaccagcagcagcagcaggtggctgggggtgcgttgggggccacggaggcccagccccagggccacctgcagaggtactccacgcagatccacagcttccgagagggcacctagcgcccagtcctgggtgggggtggcggtggccgcagctgcctggcctgctcctcccagccccagtccctccaagccacgag

SEQ ID NO: 110779 - DNA, 796 bp, Homo sapiens
  Payload ID: 1727
  Gene Symbol: BHLHA15
  Gene Name: basic helix-loop-helix family, member a15
  Uniprot ID: Q7RTS1
  ENST ID: ENST00000609256
  CDS Start-End: 127-696
cccggggcggctaaagcgacgtgtccttgtcccccgtgggcagcctcggcgcgtgtggccgcggatccccagctccaagggcctcaccttcctgccgccacctcctaggacagccagtccagggccatgaagaccaagaaccggcccccacggcgccgggccccggtgcaggacacagaggccacccccggggaggggacgcccgacgggtccctgccgaacccggggccagagccggccaagggtctgcggagccggccggcccgggccgcagcaagggctccgggcgagggcaggcgcaggcggccaggaccctccgggcccggtggccgtcgtgacagcagcatccagcggcggctggagagcaacgagagggagcggcagcggatgcacaagctaaataacgccttccaggccctgcgtgaagtcatcccccacgtgcgcgcggacaagaagctctccaagatcgagacgctcacgctggccaagaactacatcaaatcgctgacggccaccatcctgaccatgtccagcagccgcctcccaggcctggaggggccgggccccaagctctaccagcactaccagcagcagcagcaggtggctgggggtgcgttgggggccacggaggcccagccccagggccacctgcagaggtactccacgcagatccacagcttccgagagggcacctagcgcccagtcctgggtgggggtggcggtggccgcagctgcctggcctgctcctcccagccccagtccctccaagccacgagccccagatgggcggtgacac

SEQ ID NO: 110780 - DNA, 902 bp, Homo sapiens
  Payload ID: 1728
  Gene Symbol: BHLHA9
  Gene Name: basic helix-loop-helix family, member a9
  Uniprot ID: Q7RTU4
  ENST ID: ENST00000391429
  CDS Start-End: 6-713
aggccatgctgcggggcgcgccaggactaggcctcacggcgcggaagggggccgaggactctgcggaggacttggggggcccctgccccgagcccgggggcgattcgggggtgctgggggcgaacggcgcttcctgcagccggggcgaggcggaggagccggcgggcaggaggcgcgcgcggccggtgcggtccaaggcgcggcgcatggccgccaacgtgcgggagcgcaagcgcatcctagactacaacgaggccttcaacgcgctgcgccgggcgctgcggcacgacctgggcggcaagaggctctccaagatcgccacgctgcgcagggccatccaccgcatcgccgcgctctccctggtcctgcgcgccagccccgcgccccgcgggccctgcggacacctggagtgccacggcccggccgcgcgcggggacaccggggacacaggcgccagccccccgccgcctgcagggcccagcctcgcgcgcccagacgccgcccgcccctcggtgccgtccgcgccccgctgcgcctcgtgccccccgcacgcgcccctggcacggcccagtgcggtggccgaggggccgggcctagcacaggcctccgggggaagctggcgccgctgtccgggggcttcctctgccgggccgcctccctggccgcggggctacctgcgatccgcccccgggatgggccatccgcgctcctgaccggcctcgaggcaccggctgggctgcagggaggccgggctggcagctggactataaaacccgggactgcaaaggcgtcttggacagagcagaactggaccggctgagacctggcgtggaagagaaggagctcgccagagagaaggagctccgggacccggggttgcgcccccacatcccagcctgggg

SEQ ID NO: 110781 - DNA, 3262 bp, Homo sapiens
  Payload ID: 1729
  Gene Symbol: BHLHE22
  Gene Name: basic helix-loop-helix family, member e22
  Uniprot ID: Q8NFJ8
  ENST ID: ENST00000321870
  CDS Start-End: 425-1570
aaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgccgccgcctggaggaggcggcggcggcagcgcgggaagtggcggcggcggcggcggcggggtgggtgtccccgggctgctagtaggttcagccggcgttgggggcgaccctagcctaagcagcctgccggccggggccgccctttgcctcaagtacggcgaaagcgcgagccggggctcggtggccgagagcagcggcggcgagcagagccccgacgacgacagcgacggtcgctgcgagctcgtgctgcgggccggagtagccgacccgcgggcctccccgggagcgggaggtggtggcgcgaaggcagccgagggctgctccaatgcccacctccacggcggcgccagcgtccccccggggggcctgggcggcggcggcggcgggggtagcagcagcggtagcagtggcggcggtggcggtagcggtagcggcagcggcggcagcagcagcagcagcagcagcagcagcaagaaatccaaagagcaaaaggcgctgcggcttaacatcaatgcccgagagcgccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggaggagatgcggcgcctagtcgcctacctcaaccagggccaggccatctcggctgcctccctgcccagctcggcggctgcagcggcagcagctgctgccctgcacccggcgctcggcgcctacgagcaggcagccggctacccgttcagcgccggactgcccccggctgcctcctgcccggagaagtgcgccctgtttaacagcgtctcctccagcctctgcaaacagtgcacggagaagccttaaacacacccccgaaaaacacaagaccgacccaaaatctagaggaaagcgaaaagctgctccccaccccctttattttggtcctctcgtagttgtgaaacacttgcagagcaaacaaagcagaggcaagaactgaggagaagtatcagagacaaacgggacttttagccttgacatccccagaatctcggtctttggggtggggagggagggaggagggaggtggagttgggatggagtatggatgtcttttttttctcagaaaagtggcaactttggtggcagcctagaccgcgaggaagtggaatcttccttaaaggtgaaacataagttgagaagtagtgcttggttattaagcctggagagtgtttgaatggcaaaatactaatcctactaataattgtggatttggctagtgctgagggggagaggaggggttaggggttgggtagcatgagagatggaatattcattcagacaaatcagaaagggcacttgaaaataaattttgattctgagccaggagaaaaacttgaaatgttgacttaagtgagggggaaataaaacccagagagagagagagagcgagagagagagacatgttactatgaaagacttgtattttttattgtctctgaactttaatcctgtgaaaatgctcaaagttttggcgagagtgatataaaaaaactgactgtggctgaaagaattgcatttaaaaatatttatgtgcaccttgttactttctactctgcaatgatgtattaacaattcatggtatttatttgttattcttcaatgacccttccacatcaacagtatttatcatgtgttaaagtcatgggtcttatgtgcagatttttttaatgcctctaaaattgttttatagattacttatgctgtgtgccaagtgtttaaaggtttatttgccaacaagtatgaagagaaatattgatgtatctgagctgcttaggtttatgaaaggtcacctggatattttcagttgcatcatccctgtatttaaattgagctttaataaattgcttcagtccaaaaattacaggaaaggtgtattcttaattgatgaatgaattgatctcttttttgaaaggggactcctttacattccaaaagggaaaaacatcacagcaatagttgctatacgtaagaacatgctaagcaaatatttttccaggctgtgctgtgcatttttaaaaggtctaatttaattgcttttaatatatatgtacatatatgttattttaactgtggagaattatttaagttaaaagactggtttgatttgcctatggtgtgaaatcctttgttatttttctaaaaaaataaaatttaaaaagaaagaaaactaaggaagaacaagaagctatttacccaaagtgagctttcagttttagttttgcatggctgtttgactgcctttccgccctatgaaaatcaagaaaatcttttttaaaaatggagtcctgctattttccactccttgcagataatacaaattcagtttgtcaggttggatggtgagttgggagctgtgatggatctgttggcgggttttggatgtgtaaagaatgatatatatattaaataggtcaatcagactatgacagctatgtacgaccatttgtatgtgtatctatgtcagaaagaatctttattaaaatattttgatcaaac

SEQ ID NO: 110782 - DNA, 1057 bp, Homo sapiens
  Payload ID: 1730
  Gene Symbol: BHLHE23
  Gene Name: basic helix-loop-helix family, member e23
  Uniprot ID: Q8NDY6
  ENST ID: ENST00000370346
  CDS Start-End: 310-987
tgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtgaccgcgcgggcccccggccctcccgcacgcgtcctccgatcgcccctgtgactgtctctctgcccggacag

SEQ ID NO: 110783 - DNA, 1109 bp, Homo sapiens
  Payload ID: 1730
  Gene Symbol: BHLHE23
  Gene Name: basic helix-loop-helix family, member e23
  ENST ID: ENST00000612929
  CDS Start-End: 262-987
tgattggacagcagcgaggtcccaccgggcgcctccgcggcttaaaaccgaagcgggggcgagggggaggtagagcccgccccctgcgcgtcgcggctgggagggagaggaggtgggagagaaggaagaggcggaggaggcagcgggcgccgaggctctgggacccgcaggcaagccagaccgacgcgcagagccgggagcctcatcgcagcggcagcggcagcggcgggctcgggccggcctcgggggctgctcacccacatgagcatccgcccacccggcgagcccccgagcccaggcggcgcggccatggccgagctcaagtcgctgtcgggggacgcgtacctggcactaagccacggctacgcggcggcggctgcgggtctcgcctacggggcggcgcgagaacccgaagcggcccgcggctacggcactccgggcccgggcggcgacctccccgcggcgcctgcacctcgcgccccagctcaggcggcggagagcagcggcgaacagagcggggacgaggacgacgccttcgagcagcggcggcggcggcgcgggccagggagcgcggcggacgggcggcggcggccgcgagagcagcggtctctgcggctcagcatcaacgcgcgcgagcggcggcgcatgcacgacctaaacgacgcgctggacgggctgcgagccgtcatcccctacgcgcacagcccgtcggtgcgcaagctctccaagatcgccacgctgctgctcgccaagaactatatcctcatgcaggcgcaggccctggacgagatgcggcgcctggtggccttcctcaaccagggccagggcctggccgcgcccgtaaacgccgcgcccttgacgcccttcggccaggccactgtgtgccccttctccgcaggcgccgccctggggccctgccctgacaagtgcgccgccttctccgggacgccctccgcgctttgcaaacactgtcacgagaagccgtgaccgcgcgggcccccggccctcccgcacgcgtcctccgatcgcccctgtgactgtctctctgcccggacaggaaaggcctggagggaccctgcagaccaggaggagggggcccgacttcgctt

SEQ ID NO: 110784 - DNA, 3473 bp, Homo sapiens
  Payload ID: 1731
  Gene Symbol: BHLHE40
  Gene Name: basic helix-loop-helix family, member e40
  Uniprot ID: O14503
  ENST ID: ENST00000256495
  CDS Start-End: 604-1842
gcggccgcagccgcagacacctgggggccggggctgggggtgggggctccctagcagccgccggagcgttgtccaacacgtgagactcatgtgatgaagccgggggagggcgggcaggtcgctccttccctccccggcagtggccagacgtgcctggagtcacagggtagaacacgtagctccaacccacccactcgctcccatttaacccagcccgcagcctctccattactcctcggcttgcccccccacccccccactccgccctaaccgcccccccctcacccgctccctcccgcctccccgcccgccccacttctcattcacttggctcgcacggcgcagacagaccgcgcagggagcacacaccgccagtctgtgcgctgagtcggagccagaggccgcggggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaaaatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataattttttttttctctagggagaggtacagtgtttatattttggagccttcctgaaggtgtaaaattgtaaatatttttatctatgagtaaatgttaagtagttgttttaaaatacttaataaaataattcttttcctgtggaagagaaagatggtctcctgagttttttaaaatagctcacttggtgtgatatggctgactcccatgtccttctttcttggctgaagcaaaccagttaatctcagtgtaatttcattcagcttttcatgtgctttgtattcaatcagaata

SEQ ID NO: 110785 - DNA, 3837 bp, Homo sapiens
  Payload ID: 1732
  Gene Symbol: BHLHE41
  Gene Name: basic helix-loop-helix family, member e41
  Uniprot ID: Q9C0J9
  ENST ID: ENST00000242728
  CDS Start-End: 349-1797
cccccgcccccctccgggctggaccgcggatggtacgttccgcacgtgagctgggtgctggtctggccggcgacgcgcgtgccctgtggccaaacactgcctggagtgagagcaaactaccagcgcagtggggccggcgcgagtgtgcgtgtgtgtgcgtgtgtgtgtgcgagcgcggtggaggggggggaccaactgcttcacactttcaacactgcactgaagagggagagcgagagagagactggagacgcacagatccccccaaggtctcccaagcctaccgtcccacagattattgtacagagccccaaaaatcgaaacagaggaaacgaacagcagttgaacatggacgaaggaattcctcatttgcaagagagacagttactggaacatagagattttataggactggactattcctctttgtatatgtgtaaacccaaaaggagcatgaaacgagacgacaccaaggatacctacaaattaccgcacagattaatagaaaagaaaagaagagaccgaattaatgaatgcattgctcagctgaaagatttactgcctgaacatctgaaattgacaactctgggacatctggagaaagctgtagtcttggaattaactttgaaacacttaaaagctttaaccgccttaaccgagcaacagcatcagaagataattgctttacagaatggggagcgatctctgaaatcgcccattcagtccgacttggatgcgttccactcgggatttcaaacatgcgccaaagaagtcttgcaatacctctcccggtttgagagctggacacccagggagccgcggtgtgtccagctgatcaaccacttgcacgccgtggccacccagttcttgcccaccccgcagctgttgactcaacaggtccctctgagcaaaggcaccggcgctccctcggccgccgggtccgcggccgccccctgcctggagcgcgcggggcagaagctggagcccctcgcctactgcgtgcccgtcatccagcggactcagcccagcgccgagctcgccgccgagaacgacacggacaccgacagcggctacggcggcgaagccgaggcccggccggaccgcgagaaaggcaaaggcgcgggggcgagccgcgtcaccatcaagcaggagcctcccggggaggactcgccggcgcccaagaggatgaagctggattcccgcggcggcggcagcggcggcggcccggggggcggcgcggcggcggcggcagccgcgcttctggggcccgaccctgccgccgcggccgcgctgctgagacccgacgccgccctgctcagctcgctggtggcgttcggcggaggcggaggcgcgcccttcccgcagcccgcggccgccgcggcccccttctgcctgcccttctgcttcctctcgccttctgcagctgccgcctacgtgcagcccttcctggacaagagcggcctggagaagtatctgtacccggcggcggctgccgccccgttcccgctgctataccccggcatccccgccccggcggcagccgcggcagccgccgccgccgctgccgccgccgccgccgcgttcccctgcctgtcctcggtgttgtcgccccctcccgagaaggcgggcgccgccgccgcgaccctcctgccgcacgaggtggcgccccttggggcgccgcacccccagcacccgcacggccgcacccacctgcccttcgccgggccccgcgagccggggaacccggagagctctgctcaggaagatccctcgcagccaggaaaggaagctccctgaatccttgcgtcccgaaggacggaggttcaagcagagtgagaagttaaaatacccttaaggaggttcaagcagagtgagaagttaaaatacccttaaggtctttaagggaggaagtgtaatagatgcacgacaggcataaacaagaacaacaaaacaggtgttatgtgtacattcggagttcctgttttgctcatcccgcaccaccccaccctccacacactaacatccctttcttccccccaccagctgtaaaagatcctatgcgaaagacactggctcttttttttaatcccccaaataaattttgcccccttttaggccatgttccattatctcttaaaattggaacctaattcgagaggaagtaagaagggtctgttctgtggctgagctaggtgaaccccggggtaggggaaagatgttaacacctttgacgtctttggagttgacatggaacagcaggtagttgttatgtagagctagttctcaaagctgccctgcctgttttaggaggcgttccacaaacagattgaggctcttttagaattgaatttactcttcagtattttctaatgttcagctttctaaaaggcatatatttttcaaagaagtgaggatgcagtttctcacgttgcaacctattctgaagtggtttaaatggtatctcttagtaacttgcactcgttaaagaaacacggagctgggccatcgtcagaactaagtcagggaaggagatggatgagaaggccagaatcattcctagtacatttgctaacactttattgagaaattgaccatgaattaatggactcatcttaatttcttctaagtccatatatagatagatatctatctgtacagatttctatttatccatagataggtatctatacatacacatctcaagtgcatctattcccactctcattaatccatcatgttcctaaatttttgtaatcttactgtaaaaaaaagtgcactgaacttcaaaacaaaacaaaaaacaacaacaacaaaaaacaagtccaaactgatatatcctatattctgttaaaattcaaaagtgaacgaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgtcagtttggtgcatttgctgctgctgttgctactgtttgcctcaaacgctgtgtttaaacaacgttaaactcttagcctacaaggtggctcttatgtacatagttgttaatacatccaattaatgatgtctgacatgctatttttgtagggagaaaatatgtgctaatgatattttgagttaaaatatcttttggggaggatttgctgaaaagttgcacttttgttacaatgcttatgcttggtacaagcttatgctgtcttaaattattttaaaaaaataaatactgtctgtgagaaaccagctggtttagaaaagtttagtatgtgacgataaactagaaattacctttatattctagtattttcagcactccataaattctattacctaaatattgccacactattttgtgatttaaaaattcttactaaggaataaaaactttaatatacgatatgatattgtctaataattaaaaaagacataatggatgctcaattagttttaagatatctataactatagggatacaaatcactacagttctcagatttacagcttttttttgtcattggcttgatgtcacacatttccaatctcttgcaagcctccaggctctggctttgtctacctgctcgttcccaatgtatcttaatgaaaagtgcaaaagaaaaacctaccaattaa

SEQ ID NO: 110786 - DNA, 6875 bp, Homo sapiens
  Payload ID: 1733
  Gene Symbol: BZW1
  Gene Name: basic leucine zipper and W2 domains 1
  Uniprot ID: Q7L1Q6
  ENST ID: ENST00000409600
  CDS Start-End: 456-1715
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccggtacatcggggatttctggctctttcctcttcgccttaaattcgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtagttctcaaaagacttttttttaaaaaaataaagtccatacttacacttaggctttatacatcagtctttttttttttaaattccatgttaatacctagtggtattgtatgttgtgtgttcagatgtctttactgtatctgtataccattaagtaataattagactcccaaactgtaaaccacctacacagaattctggtgtagctaaaactacattaatatttctacaaccaattcattgcatgtttcttccatacaaagtgtgccattttatactgtgtatagtgaaaaagtgtgtcatcttccagaactacattattatctttgatcgtagtttgtttcttcataatgacactgtagtgtttacttagtagaacattatagtaagtggatatcacttgtgacagtaatagtgtaaagaaagggaatgctttataaaaagattgcagattccattccatataaaaagattccattctgaatcttaagtggtaattttagaattcaggtgccagtgccagcctatggcctcaagtatgtaattcttaatatagatgttaaattgtacttttaattatgattggataaatgttttttctaactgtcagtttctaaggctgtctccttagaaactaaatgagtttttagagctggttgtaagtttcttagccttactctgtgagttatagatgttatttcattctatatatagatgtttattccattcttatttaaaaaaaaaaacctccatataccaaaaatgctacaggatattttgaaatagcatattttagttaggggaaatgcatgtgaccaagaggttggacttctaattcagtttttcaaaagcttttttccattatcatacccccagcctttttaggcttttttttttttttttttgagacggagtctcgctctgtcaccaggctggagtgcagtggcgcgatcttggctcactgcaagttccgcctcccgggttcacgccattctcctgcctcagcctcccgagtagctgggactacaggcgcccgccaccatgcccgactaatttttttgtatttttagtagagacgaggtttcaccggattagcgaggatggtctcaatctcctgaccttgtgatccacccgcctcagcctcccaaagtgctgggattatgggcttgagccaccgcgcccagctagacttttttctaatagagtcccccataaattttattaccatagatacgctgtgtatgtactgtttctgtgctttgtacatgaaaagagtaaaatgtttttgtttttgttttggagacagtctcactctgttacctgggctggagtgcaatggcatgatctcagctcactgcaatctctgcctcctgggttcaagcgattctcttgcttcagcctcctgagtagctgggattacaggcggccaccaccacccctggctaatttttgtatttttagtagaggtttcaccacgttgatcaggctggtctcaaactcctgacctcgtggtctgcctgccttggcctcccaaagtgctgggattacaggcgtgagccaccatgcccaaccaattttttttttttaaatccttggtagtgattgacccccattgagaatgcatgctctaatattttttaaaagggaagaagacctagtgatagacctttgcattggcaggcatgtctttatgtttatacagtgaagtagtattttttctgtcagggtcaatagaaagtagacgaaattcattttcagccaatctttcaccagttgtgctttgttccttaccccaccacaggcaacagacaaagcatttcctgctgtctttcaaggtcttaacagattctttcttgattataaatgtattactaagtagaatcatttgggttctttctataaaaatcagtgaaaatcctctagatgaatgaattaaagttgtaggcataacactgataaacctctgctctcatactgaagtaggctgcttgcaggaactgacaactattggttggctttaaatgtaatgtagatgccaaagttttagtgtacagtgttacttaaattaccaaattacctttgtacaaatattcctcagatgctgtctacaggtgccatataaaataggttgataagtatttgcaaattctggtaaattgccttgctatgatttttcatgctcagtattagtcctctagtatcaatacgaagtttttctattccccagcctactaaggcctacaggttaaaataccaggaataaaaaggttttcagtggacttgatttaagtggaatctggatgatgtgacaagtacctttgtctttggagtaatgagtttataattggcttttgtccaaaaactcttaagtggattaatatctgaacaatcttagacataattatatgaaactggatcagaaaggctttctgactcctttctcttcacttttttctcccagcttaactagaggcaattaacagtcatttcaaatctaattatttttattttccagtgtacttatcatcctttcatctttatgctaggagtatagtctcagttcttaatgagttgatgggatgaagatatagatagatagatagatagatagatagatagatatttttttttttttttttttttttttttttttttttgagacagagtctcgctctgtcgcccaggcgggagtgcagtggcacaatctcggctcactgcaagctccgccttgggggttcacaccattctcctgtctcagcctcctagctgggattacaggcgcccaccaaccaagcccggctaaggtatttttaaatgtactcaatcactgtcattttagtaaccttgaatcagaacctcagttgttaaaggcttaactgcttgtggcaactactatagtgctctagtggggacagtggttaaaatctgcagaatcccttgctttgtcatcttatccagaaggactgatagcttgttaaactgtggtatgattagaatgttggtggttgtgtagtgcatttggggtgctacaacgttaatcaaatataattgagctgttctgtttccagtcagtgtaaccatttaaaaataccttggcaaaacaagctaggagctagttcatgctaatattcttaaggacaaaaatagtttacagcttttttttttttaatctgaaatcctgaaggctatgcttaaaagttagagataaacctgttggaaataagtgattcatttatagactgaagcctctatgacttcaaaaagatactcaacagtctctggcatttgaagaacaaaatattttctctgtaaatacacctcatttccattctagttaggagcaatggcgcccaggacggcacacagaatggagaaaactggatagctggtaactcatttagctcttggcactctaaaaaacctcaaatacagccatccaagccagtaattctattgctgcgttatttctgtgtttaactgtgaaacttgcttcttgtctgtacccttgaaatggaataaaatttcatgagactccttgttaatgtagagaaaa

SEQ ID NO: 110787 - DNA, 2455 bp, Homo sapiens
  Payload ID: 1733
  Gene Symbol: BZW1
  Gene Name: basic leucine zipper and W2 domains 1
  Uniprot ID: Q7L1Q6
  ENST ID: ENST00000409226
  CDS Start-End: 124-1395
cgggtggggaggtggggtccgggtgtgcgccgcggcgctggctgcgaaggcagtggccgaggcgggctccctctgggccgtgcccggcctggctaacaaagccgccgcggcctctgttgtgtgatggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatgtggcagaggtggtgggaagaagaaagttgagctttttccccttgagaaacttctgcatttagtttctatctttccaggcaaaacaaatgggtattcttttcatacaaccattttcaaatgaaccttagaaaagtcttaacatttaaggtattttatgcacagaatacacttagattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactg

SEQ ID NO: 110788 - DNA, 1075 bp, Homo sapiens
  Payload ID: 1733
  Gene Symbol: BZW1
  Gene Name: basic leucine zipper and W2 domains 1
  ENST ID: ENST00000410110
  CDS Start-End: 193-1075
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccaggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaa

SEQ ID NO: 110789 - DNA, 1059 bp, Homo sapiens
  Payload ID: 1733
  Gene Symbol: BZW1
  Gene Name: basic leucine zipper and W2 domains 1
  ENST ID: ENST00000452206
  CDS Start-End: 412-1059
gacttccggtgctggaggagggggccggcggcgagggactccaggaggacgcgtccaacttcgagaccggcgggggccggctccgctcttccaacccctccatgtgtgaagagggcggacgacgcagcgggggaagaaaaataagctagtctaggacaagtgtccaggcgacgtggaacccagtaagggaataaagaagactggaaacgtctctcccctcccctatcccagtccctcaccctaatccgcgcgcaatagaaaaggcggaagcgcctgtccacgatcagggcggggcaaggggaagaaatctcgcgataggagagcggtccgggcgggggtggcacctctccctcctcctggcgttagttccggtcgcagaggagacaccgccgcagttgccgggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatg

SEQ ID NO: 110790 - DNA, 557 bp, Homo sapiens
  Payload ID: 1733
  Gene Symbol: BZW1
  Gene Name: basic leucine zipper and W2 domains 1
  ENST ID: ENST00000447069
  CDS Start-End: 209-557
agttttgcaggcctgagtggtgcaaggcggccgctgttgcggtcacaggcatgacctagggtaggatggtgctgcccgtaaccaggcttgtcagaagaaggggttcaccttttgacagtgttttagaattggcatacacattttggatgcctgctgactatggtgataatctctctttgcgttctgcgatgcttagtggtcgtggaagatggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcagg

SEQ ID NO: 110791 - DNA, 1473 bp, Homo sapiens
  Payload ID: 1733
  Gene Symbol: BZW1
  Gene Name: basic leucine zipper and W2 domains 1
  Uniprot ID: Q7L1Q6
  ENST ID: ENST00000452790
  CDS Start-End: 53-1408
accaccgctgcggccgccgcctccgccgctgctttcgctggagggcgggcggatgtacggggcgcctggggccccggcgcaaagcgcctcagtgactgtggtccgctcgttgcggcggccgccaccgcaggcgacaggggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaacacttaatgcatccattcttaatagcctttataatgaaaatttggttaaagaaggagtttcagcagcttttgctgtgaagctctttaaatcatggataaatgaaaaagatatcaatgcagtagctgcaagtcttcggaaagtcagcatggataacagactgatggaactctttcctgccaataagcaaagtgttgaacacttcacaaaatattttactgaggcaggcttgaaagagctttcagaatatgttcggaatcagcaaaccatcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaaggtcagtctgagctgactctgttactgaagattcaggagtattgctatgacaacattcatttcatgaaagccttccagaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgt

SEQ ID NO: 110792 - DNA, 779 bp, Homo sapiens
  Payload ID: 1733
  Gene Symbol: BZW1
  Gene Name: basic leucine zipper and W2 domains 1
  ENST ID: ENST00000359893
  CDS Start-End: 1-407
tcggagctcgtaaggagctccagaaagaacttcaagaacagatgtcccgtggtgatccatttaaggatataattttatatgtcaaggaggagatgaaaaaaaacaacatcccagagccagttgtcatcggaatagtctggtcaagtgtaatgagcactgtggaatggaacaaaaaagaggagcttgtagcagagcaagccatcaagcacttgaagcaatacagccctctacttgctgcctttactactcaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataattt

SEQ ID NO: 110793 - DNA, 557 bp, Homo sapiens
  Payload ID: 1733
  Gene Symbol: BZW1
  Gene Name: basic leucine zipper and W2 domains 1
  ENST ID: ENST00000419090
  CDS Start-End: 73-557
aatttgaagggtttcttgtagagagaaatgcacattttgacgtacatttgattcaagtgcagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactggtgttcttctggctaatggaac

SEQ ID NO: 110794 - DNA, 578 bp, Homo sapiens
  Payload ID: 1733
  Gene Symbol: BZW1
  Gene Name: basic leucine zipper and W2 domains 1
  ENST ID: ENST00000450637
  CDS Start-End: 115-578
agaaagaaaaggtatcagtacagaaaagaagagtcagaaaataccgtgcaaaggcacattcagaacgtaaccaggatagctggagccaggattcaaggagagagggtgtcttttatgaataatcaaaagcagcaaaagccaacgctatcaggccagcgttttaaaactagaaaaagagatgaaaaagagaggtttgaccctactcagtttcaagactgtattattcaaggcttaactgaaaccggtactgatttggaagcagtagctaagtttcttgatgcttctggagcaaaacttgattaccgtcgatatgcagaaacactctttgacattctggtggctggtggaatgctggccccaggtggtacactggcagatgacatgatgcgtacagatgtctgcgtgtttgcagcccaagaagatctagagaccatgcaagcatttgctcaggtttttaacaagttaatcaggcgctacaaatacctggagaaaggttttgaagatgaagtaaaaaagctgctgctgttcttgaagggtttttcagagtcggagaggaacaagctagctatgttgactgg

SEQ ID NO: 110795 - DNA, 1860 bp, Homo sapiens
  Payload ID: 1734
  Gene Symbol: BZW2
  Gene Name: basic leucine zipper and W2 domains 2
  Uniprot ID: Q9Y6E2
  ENST ID: ENST00000258761
  CDS Start-End: 166-1425
ggcggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctggg

SEQ ID NO: 110796 - DNA, 898 bp, Homo sapiens
  Payload ID: 1734
  Gene Symbol: BZW2
  Gene Name: basic leucine zipper and W2 domains 2
  ENST ID: ENST00000407633
  CDS Start-End: 112-789
gtggtaccaggacttagactaatcagtagtcacctggactggataaaaggggacctcttttaggaaggaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaa

SEQ ID NO: 110797 - DNA, 1689 bp, Homo sapiens
  Payload ID: 1734
  Gene Symbol: BZW2
  Gene Name: basic leucine zipper and W2 domains 2
  ENST ID: ENST00000405202
  CDS Start-End: 265-1296
tgccgccactgctgctgctgctgctgctgccgctgctgctgcacgaatcgccgcagcccccagccttgcgcgtcgtcgctacctcctcggacagatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttga

SEQ ID NO: 110798 - DNA, 1784 bp, Homo sapiens
  Payload ID: 1734
  Gene Symbol: BZW2
  Gene Name: basic leucine zipper and W2 domains 2
  ENST ID: ENST00000436868
  CDS Start-End: 123-635
gtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctt

SEQ ID NO: 110799 - DNA, 1862 bp, Homo sapiens
  Payload ID: 1734
  Gene Symbol: BZW2
  Gene Name: basic leucine zipper and W2 domains 2
  Uniprot ID: Q9Y6E2
  ENST ID: ENST00000433922
  CDS Start-End: 179-1438
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggcttttt

SEQ ID NO: 110800 - DNA, 1405 bp, Homo sapiens
  Payload ID: 1734
  Gene Symbol: BZW2
  Gene Name: basic leucine zipper and W2 domains 2
  ENST ID: ENST00000415365
  CDS Start-End: 182-1405
ggcggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgca

SEQ ID NO: 110801 - DNA, 1711 bp, Homo sapiens
  Payload ID: 1734
  Gene Symbol: BZW2
  Gene Name: basic leucine zipper and W2 domains 2
  ENST ID: ENST00000437745
  CDS Start-End: 153-638
atgtcaatgtgtctgtccttcactcctccattgtctgccgccactgctgctgctgctgctgctgccgctgctgctgcacgaatcgccgcagcccccagccttgcgcgtcgtcgctacctcctcggacaggtgagaagcagcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctggg

SEQ ID NO: 110802 - DNA, 1464 bp, Homo sapiens
  Payload ID: 1734
  Gene Symbol: BZW2
  Gene Name: basic leucine zipper and W2 domains 2
  ENST ID: ENST00000452975
  CDS Start-End: 471-1040
cattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggcttttt

SEQ ID NO: 110803 - DNA, 859 bp, Homo sapiens
  Payload ID: 1734
  Gene Symbol: BZW2
  Gene Name: basic leucine zipper and W2 domains 2
  ENST ID: ENST00000446596
  CDS Start-End: 38-859
cagtcattcccttgtagggacaactagaagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggag

SEQ ID NO: 110804 - DNA, 674 bp, Homo sapiens
  Payload ID: 1734
  Gene Symbol: BZW2
  Gene Name: basic leucine zipper and W2 domains 2
  ENST ID: ENST00000438834
  CDS Start-End: 49-674
agtttctttccaaaatggagagaactaaagaagagtcccagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcaccctgcccgccaccatcctcaccagtctcttcaccgacagcttagtcaaagaaggcattgcggcctcatttgctgtcaagcttttcaaagcatggatggcagaaaaagatgccaactctgttacctcgtctttgagaaa

SEQ ID NO: 110805 - DNA, 617 bp, Homo sapiens
  Payload ID: 1734
  Gene Symbol: BZW2
  Gene Name: basic leucine zipper and W2 domains 2
  ENST ID: ENST00000430000
  CDS Start-End: 130-617
atagtgtagcatgaagagctaaatttagagggaagtggggcctctgctccaaatagtaacagctaaaggatagacactcttggagagcagaatatctttatttagtctgtcaccaccagtggaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaagcttctcctcttccttaaagccttttccgaaacagagcagacaaagttggcgatgctgtcggggattctgctgggcaatggcac

SEQ ID NO: 110806 - DNA, 1721 bp, Homo sapiens
  Payload ID: 1734
  Gene Symbol: BZW2
  Gene Name: basic leucine zipper and W2 domains 2
  ENST ID: ENST00000630952
  CDS Start-End: 163-648
ggggctgcgccgggttccgtgtgtctatgtcaatgtgtctgtccttcactcctccattgtctgccgccactgctgctgctgctgctgctgccgctgctgctgcacgaatcgccgcagcccccagccttgcgcgtcgtcgctacctcctcggacagaaattttatgaataagcatcagaagccagtgctaacaggccagcggttcaaaactcggaaaagggatgaaaaagagaaattcgaacccacagtcttcagggatacacttgtccaggggcttaatgaggctggtgatgaccttgaagctgtagccaaatttctggactctacaggctcaagattagattatcgtcgctatgcagacacactcttcgatatcctggtggctggcagtatgcttgcccctggaggaacgcgcatagatgatggtgacaagaccaagatgaccaaccactgtgtgttttcagcaaatgaagatcatgaaaccatccgaaactatgctcaggtcttcaataaactcatcaggagatataagtatttggagaaggcatttgaagatgaaatgaaaaaggcattgcggcctcatttgctgtcaagcttttcaaagcatggatggcagaaaaagatgccaactctgttacctcgtctttgagaaaagccaacttagacaagaggctgcttgaactctttccagttaacagacagagtgtggatcattttgctaaatacttcactgacgcaggtcttaaggagctttccgacttcctccgagtccagcagtccctgggcaccaggaaggaactgcagaaggagctccaggagcgtctttctcaggaatgcccgatcaaggaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaagcaatatgctcccctgctggccgtgttcagctcccaaggccagtcagagctgatcctcctccagaaggttcaggaatactgctacgacaacatccatttcatgaaagcctttcagaagattgtggttctcttttataaagctgatgttctgagcgaagaagcaatactgaaatggtataaggaagcacatgttgctaaaggcaaaagtgtttttcttgaccagatgaagaaatttgttgagtggttacaaaatgcagaagaagaatccgaatcggaaggtgaggaaaattaaatggctcaacaagcacaatacctaggttaccacacaccactttttgattgggaatgctgaaccatttgagaagagaaacttggcttctgttttcgcaaaggaaaaaaaaaataggataggcttcccttgtgcagagggagaaatggttttgtttttgttttgtttttaaatggagccctgaggcatcagctattatacttgggactctacctctcactcactatatgctaacttaaagccattcaacaaggagtcaagtagatctgaaattaaatactcaacagactcctccttttttagctgtatttttcaggtactgtgtggtgaccgccccactggtgtctattacaggccactttggtagttgtgtatctgctcatgtatgtgatttgacaaaccagttttttaaaataaatggctttttaaaaatctggg

SEQ ID NO: 110807 - DNA, 2300 bp, Homo sapiens
  Payload ID: 1735
  Gene Symbol: BLZF1
  Gene Name: basic leucine zipper nuclear factor 1
  Uniprot ID: Q9H2G9
  ENST ID: ENST00000329281
  CDS Start-End: 424-1626
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaagaataaacaactaaataactgtattagaaaaaaaagaaacttactaaatatcataatctgatgatatgtggtcctgaattggctactagtttaagcaaataaactgtaagtcatttatgggttagttggggaataaatggatatgggctggatattcggtaatatcattaatgaaaagcagattgcagaaatacagtatgatctcagtattttgaaattgtaaatacatgtacagacaaatacttagacagtatgcatactggtgttaacagtcacaatttctgggtgatgaaaatgtaacttgaaaccgctccatttctacaatgcacatttactgtttctgttataataaaagggtatgttagaaaaacaaaaaggaggctgggcatggtggctcatgcctctaatctcagcactttgggaggccaaggtgggcggatcacttgaggtctggagtttgagaccagcctgagcaacatggtgagaccccatctctacaaaaaaaatataaaaattagccaggtgtggtggtgcacacctgtggtcccagctacttgggaggctgaggtgggaaaatcacttgaacctgggagggtgaggttgcagtgagctgagatcatgccactgcactccagcctgggtgacagg

SEQ ID NO: 110808 - DNA, 1295 bp, Homo sapiens
  Payload ID: 1735
  Gene Symbol: BLZF1
  Gene Name: basic leucine zipper nuclear factor 1
  Uniprot ID: Q9H2G9
  ENST ID: ENST00000367807
  CDS Start-End: 424-948
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataa

SEQ ID NO: 110809 - DNA, 2749 bp, Homo sapiens
  Payload ID: 1735
  Gene Symbol: BLZF1
  Gene Name: basic leucine zipper nuclear factor 1
  Uniprot ID: Q9H2G9
  ENST ID: ENST00000367808
  CDS Start-End: 424-1626
ttgtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctcctaagtgaacgggaacagtttcgtcaagaaatgatagctacccagaaattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggttctaagaattttagatccagttacctgcaaagagagttcacctgataatccattttttgagtcttcaccaaccaccttacttgctacaaagaaaaatattggacgatttcatccctatactagatatgaaaatataactttcaattgctgcaatcactgccggggagaactgattgccctttaacagtcaatatgttggaggcatgctaaggtacttccttattacccaagagtcattattatttgggagctggggttcttacaatgctagaaataatatcacttcctatttacataatgtatacacccaaagatattttatgtactagactccagattaccctttcttaataaatatctcagggtaaggaaagaaagaaactgtatagatatatttaaaatagagaatactttccaagcaatacatgatacttttcctaaaagactctaaaagaaaaagattctgtaactctcttttagcaccaaattattgtttatcttgctggatattttatatgaacagtgttaatttagatgcactaaagcaaaggtaggcaaactacaaccatgagtcaaacatggccacacccattcatgtgctattgtctaagctggttttgcactacaactgcagagttgaatagatgcagcagatcctttacagaaaaagttttctgacctcaattctaaagtaattgtagtagggagctggaggactttctttccctttatggtaattttttgagctacaaaagagccttgcagaaatgggtgaagggattaatcttttaaaaataaatgctatatattaggaaaataaaaaatattttagagccaagttaacaagtacttcagcaaaacatgctagttttatgcaggggattctgtattccaaatggatacaatccgacatatataaaagaaacagattcttaactattgactcttatttagcaaatgcaacagacaagaatatccaacttgatatttataaaaggtagactttttccaaaagtgtataagctcaaagaaaaaatgcaacctgtcaattaatatatactatgtaatatatattattgtgtatttatgattagccatcataaatgcccattgcttggcctttaagaataatcacaaaatatttatattaaattatacaaatttgttgcagaagtgcctgtgagagaaatcttcaaaagacaaacctggtcaaataataataattttaatgtcaatgattttttttgtctgactcatctgagttatatttagttttcaagtggcaataaatttatctaccttcttta

SEQ ID NO: 110810 - DNA, 926 bp, Homo sapiens
  Payload ID: 1735
  Gene Symbol: BLZF1
  Gene Name: basic leucine zipper nuclear factor 1
  ENST ID: ENST00000426663
  CDS Start-End: 177-926
tcggcttccgaatggaagaggtctgtgagaagttaacctggtgataccgatccgaagagcctatcaagtgaagccccctgaaatacggagaataagaatcttagaggtaaatccgaggacaagcaggttgttcagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaaatcgtgagttaaaaaagttactggtggcttctgttggggatgatcttcagtatcactttgaacgtctagcccgtgagaaaaatcagcttattttagaaaatgaagccctaggtcgaaacacagctcagctttctgaacagttagaacgtatgtcaatacagtgtgatgtatggcgaagtaaattccttgcaagcagggtaatggcagatgagttaaccaactcaagagcagctttacagcgtcaaaaccgtgatgcacacggggctatacaagatctc

SEQ ID NO: 110811 - DNA, 795 bp, Homo sapiens
  Payload ID: 1735
  Gene Symbol: BLZF1
  Gene Name: basic leucine zipper nuclear factor 1
  ENST ID: ENST00000420531
  CDS Start-End: 413-795
gtttaacagctggcccggaagtttaagtgaatatgcggcttgggctccaaaagttgctgtacggtattttattttaaagtagaaatctgtccgcttttcacttacggaggccttacagtgtgtgttctgtgttacttgagtttatacgcactgcagaatttgtttaccctgctcttttggaaacgtattccggaagcgaaaccctgagtaatcggaagtggttaggagtgagagagctgctggatatgcggagggactgggcgggtcggcttccgaatggaagaggtctgtgagaagttaacctggtgataccgatccgaagagcctatcaagtgaagccccctgaaatacggagaataagaatcttagagcagaagtcttggagtgcattttcagtggttaaggtgaaaaaatgactactaaaaatttagaaaccaaagtcaccgttacttcatccccaatccgaggagcaggagatggaatggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaa

SEQ ID NO: 110812 - DNA, 980 bp, Homo sapiens
  Payload ID: 1736
  Gene Symbol: BATF
  Gene Name: basic leucine zipper transcription factor, ATF-like
  Uniprot ID: Q16520
  ENST ID: ENST00000286639
  CDS Start-End: 259-636
gagttaccagaaaccacaagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaaggccgacaccctgcacctggagagcgaagacctggagaaacagaacgcggctctacgcaaggagatcaagcagctcacagaggaactgaagtacttcacgtcggtgctgaacagccacgagcccctgtgctcggtgctggccgccagcacgccctcgccccccgaggtggtgtacagcgcccacgcattccaccaacctcatgtcagctccccgcgcttccagccctgagcttccgatgcggggagagcagagcctcgggaggggcacacagactgtggcagagctgcgcccatcccgcagaggcccctgtccacctggagacccggagacagaggcctggacaaggagtgaacacgggaactgtcacgactggaagggcgtgaggcctcccagcagtgccgcagcgtttcgaggggcgtgtgctggaccccaccactgtgggttgcaggcccaatgcagaagagtattaagaaagatgctcaagtcccatggcacagagcaaggcgggcagggaacggttatttttctaaataaatgctttaaaagaaaccagtctgacaaggcagtttctc

SEQ ID NO: 110813 - DNA, 361 bp, Homo sapiens
  Payload ID: 1736
  Gene Symbol: BATF
  Gene Name: basic leucine zipper transcription factor, ATF-like
  ENST ID: ENST00000555504
  CDS Start-End: 124-345
aggaggcacctgtagggggtggtgggctggtggcccaggagaagtcaggaagggagcccagctggtgacaagagagcccagaggtgcctggggctgagtgtgagagcccggaagatttcagccatgcctcacagctccgacagcagtgactccagcttcagccgctctcctccccctggcaaacaggactcatctgatgatgtgagaagagttcagaggagggagaaaaatcgtattgccgcccagaagagccgacagaggcagacacagaagagtattaagaaagatgctcaagtcccatggcacagagcaaggcgggcagggaacggttatttttctaaataaatgctttaaaagaaac

SEQ ID NO: 110814 - DNA, 2142 bp, Homo sapiens
  Payload ID: 1737
  Gene Symbol: BATF2
  Gene Name: basic leucine zipper transcription factor, ATF-like 2
  Uniprot ID: Q8N1L9
  ENST ID: ENST00000301887
  CDS Start-End: 132-956
gaaactgaaacttggccctctgggggcggagtggccactggggatttaaagagctgccacttccttaggcctccagagggcactgggaagtcacagctgctgagggaccactctgctcccccgcctaagccatgcacctctgtgggggcaatgggctgctgacccagacagaccccaaggagcaacaaaggcagctgaagaagcagaagaaccgggcagccgcccagcgaagccggcagaagcacacagacaaggcagacgccctgcaccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttttc

SEQ ID NO: 110815 - DNA, 1949 bp, Homo sapiens
  Payload ID: 1737
  Gene Symbol: BATF2
  Gene Name: basic leucine zipper transcription factor, ATF-like 2
  Uniprot ID: Q8N1L9
  ENST ID: ENST00000435842
  CDS Start-End: 196-765
agaaagaaggcgagagagaggagaccggaggtctgagctgcagccactacacaggcctggaattctaccacagggaatttgcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctggcccaggcatcctaggggctgaaatcctggaaaccgtgggctggtgtgagaaggtttgcatgctcagagcagagaagggctctccccactgcttcgtgattccagggccagagccatgcagtcccagaaaccccaacctagctggggcaggtccagagtccaagccctggtgggtagaggccaagcagaagccctgaagtggactcttgcttcccctagtagtgttttcagtgccaagaagctgaaactgtgagctggagttggggagaggtctggaagaggaccatctgggatttctacagcctgggtacccatagccacaccaaggcttctgggagattctgcagggtcagctttccaggctgttcccaaatagctccctgcctccccactgcccctaaagccacagcagaagagccattcatctcataaacaaaaaggaagaggaaagaatgaggaaggaccctgtgcaaggttatttgcaggcagggatgggcttgtacctgacagcacccacccctgtgtggcccccaggccctcatcaccctcagacccctcctaagcagttccctcattgctctttggactaggctgacagcaggaagagcagggcccatgaccgggtggaagttcagttttggtgtctgcttcaagagggggttttacactctgattccaggacaagcactctgaggcgggtgggggagagaaaccctggctcttcacccaggtttcacacacatgtaaatgaaacactatgttagtatctaacacactcctggatacagaacacaagtcttggcacatatgtgatggaaataaagtgttttgcaatcttt

SEQ ID NO: 110816 - DNA, 1230 bp, Homo sapiens
  Payload ID: 1737
  Gene Symbol: BATF2
  Gene Name: basic leucine zipper transcription factor, ATF-like 2
  ENST ID: ENST00000527716
  CDS Start-End: 133-885
aagaaagaaggcgagagagaggagaccggaggtctgagctgcagccactacacaggcctggaattctaccacagggaatttggtgggtgcctctaaagggctttaacctgcaattaatgacatggttgctgaatggctcctgtgggcaagagaataggtggtttgggggacacacgggttggaggcccgtgcatatcccagcagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactgtcccttggccccgctgtggttgctgaacctcctgtccagctgtcccccagccctctcctgtttgcctcgcacactggttccagcctgcaggggtcttcctctaagctcagtgccctccagcccagcctcacggcccaaactgcccctccacagcccctcgagctggagcatcccaccagagggaagctggggtcctctcccgacaacccttcctctgccctggggcttgcacgtctgcagagcagggagcacaaacctgctctctcagcagccacttggcaagggctggttgtggatcccagccctcaccctctcctggcctttcctctgctctcctctgctcaagtccacttctaacctggtcttcggagctgggttggccccttctttgggctcaggaagcagccttagcacacgggcctctcctccctcactactgggtgctgccctgcgtggctgaccagctggcccaggatttcacagtcgaaaaggaagccaccactgatgcctcccactgtgacaggccctgtcaccaccaatatcttatttcaacctcacagttgacctgagaaatcgagattatcactccactttttcagacaaggaaactgaggctcagggaagccaagtgacaagtccaaggtcacgaagactttcttggagcccgaaacaccaccctctgctcctccttctcctgtcctg

SEQ ID NO: 110817 - DNA, 569 bp, Homo sapiens
  Payload ID: 1737
  Gene Symbol: BATF2
  Gene Name: basic leucine zipper transcription factor, ATF-like 2
  ENST ID: ENST00000534177
  CDS Start-End: 105-569
ggagtggccactggggatttaaagagctgccacttccttaggcctccagagggcactgggaagtcacagctgctgagggaccactctgctcccccgcctaagccatgcacctctgtgggggcaatgggctgctgacccagacagaccccaaggagcaacaaaggcagctgaagaagcagaagaaccgggcagccgcccagcgaagccggcagaagcacacagacaaggcagacgccctgcaccagcacgagtctctggaaaaagacaacctcgccctgcggaaggagatccagtccctgcaggccgagctggcgtggtggagccggaccctgcacgtgcatgagcgcctgtgccccatggattgtgcctcctgctcagctccagggctcctgggctgctgggaccaggctgaggggctcctgggccctggcccacagggacaacatggctgccgggagcagctggagctgttccagaccccgggttcctgttacccagctcagccgctctctccaggtccacagcctcatgattctcccagcctcctccagtgccccctgccctcactg

SEQ ID NO: 110818 - DNA, 980 bp, Homo sapiens
  Payload ID: 1738
  Gene Symbol: BATF3
  Gene Name: basic leucine zipper transcription factor, ATF-like 3
  Uniprot ID: Q9NR55
  ENST ID: ENST00000243440
  CDS Start-End: 224-607
ggggcagacgtgggacgggaaggacggctgccgggactggcgcgcggggacactgggccgacgcgtggagtagcggggagagcgggaagcctgagggggcggggccggcgcgaggccgtgggtgcggcacgaggatgccggcggcgggacagcgcccgtaggcagccccacgggcagggcgcgcgggcggggcggggcgggccgggccagaggagcgcccggcatgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctgg

SEQ ID NO: 110819 - DNA, 897 bp, Homo sapiens
  Payload ID: 1739
  Gene Symbol: BTF3
  Gene Name: basic transcription factor 3
  Uniprot ID: P20290
  ENST ID: ENST00000335895
  CDS Start-End: 152-640
cttgaaggaagtggccttgtgtcacttccggcctccctttagctgccatcttgcgtccccgcgtgtgtgcgcctaatctcaggtggtccacccgagaccccttgagcaccaaccctagtcccccgcgcggccccttattcgctccgacaagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagta

SEQ ID NO: 110820 - DNA, 1237 bp, Homo sapiens
  Payload ID: 1739
  Gene Symbol: BTF3
  Gene Name: basic transcription factor 3
  Uniprot ID: P20290
  ENST ID: ENST00000380591
  CDS Start-End: 220-840
gctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacggtgtagtgtaa

SEQ ID NO: 110821 - DNA, 377 bp, Homo sapiens
  Payload ID: 1739
  Gene Symbol: BTF3
  Gene Name: basic transcription factor 3
  ENST ID: ENST00000507081
  CDS Start-End: 50-377
tgagcaccaaccctagtcccccgcgcggccccttattcgctccgacaagatgaaagaaacaatcatgaaccaggaaaaactcgccaaactgcaggcacaagtgcgcattggtgggaaagtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccag

SEQ ID NO: 110822 - DNA, 515 bp, Homo sapiens
  Payload ID: 1739
  Gene Symbol: BTF3
  Gene Name: basic transcription factor 3
  ENST ID: ENST00000509708
  CDS Start-End: 1-260
gtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctag

SEQ ID NO: 110823 - DNA, 4703 bp, Homo sapiens
  Payload ID: 1740
  Gene Symbol: BTF3L4
  Gene Name: basic transcription factor 3-like 4
  Uniprot ID: Q96K17
  ENST ID: ENST00000313334
  CDS Start-End: 269-745
agccccaggatgccgcgcggccacctgcacctgccgccactagcactaagagggatgcgcaaagcaggcggggcgttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttgatgttgtgtacagaatttccttttatattattcctctaccctccacctgtaaatgaatgttagtgcagtaattgtttgaaataatgcctcatccagtgttaggtcagtagctccacagtctacacagtccagaattctttctctaattgtcccaaagggggacattgtggaggcagagttagggggaaccacttcaagtggttagggacagataaataataggcagtatagcacatgaaagaaaacacacacttggaagccaggagacttgtgtcctagtcaaaactctggcattatgtgaccttggacaggtcatctaactactctgaaatttatcatcagtcaaataagattttattctgttttgttttgtttgagatggggatttgctcttgttgtccaggccgaactgcaatgttgtggtctcggctgactgcaacctccacctcccagattcaagcgattctcctgtctcagcctccacagtagctgggattttttttttttttttttgtatttttagtagagatggggttttaccatgttgcccaggccggtcttgaattcctgtcctcaggtgattcatttgcctcggcctcccaaagtgctaggattacaggcgtgagccactgcacccagcccaaatgagatgtttctaaatctaaagtttcttctgcttctgcatttctgtgaatctcatttgaaatttttcagggaagggattttatcatttgttcagagatgtctttatttttattaatacccataaaacgtttgtgtatttgcttcttcctctttctccttttgatcacattttagctacttatctagaggatctctggccaagtattcccttttattgtattgataacaattcttaatggctggcctctcttgtgtacaatgagccaatattcttttttgttctatatttttgtatcttcccctttcctgaacaaagcatatttagagtctcaaagaaatcctctccacaaagacatgttcctccctctggtgtgggtagacatagggtaagagtttggatgaaacttttgtaaattgtagtgttcttggcataaatatgaattaaatctttttttatatttaaataactagttaaatatgtgcttcttactaagattaggtattttttgccaagataacaatgataaaaacattttgggggggaaattgaccttaaaattttgggataattcaagaaatgtctgcagaaaattgatttatgatcttaatttttgtgttagtcctttgaggtttttttgtttttgtttttgttctttgtaaagcgccttatctgttttggacaagtccaaagtaaatggttgggctcttatatctgttttacccttatttttcccattaagtaatggtttaagaatatatcaagcaccttaatttgttgttaagtagctagtgcttacaggattccattaaattcactttaataagcctatgaagttcttatgaaaaacccatatctgcgatatgtttgatttgtttctttgttttaattcagtgtttaaccctaggtatgctacatacccataaataagataccatggtaagagatagtatgttatagtgggaaaagcacaagtttttagatagagatcaattctgctatctacccttacattgtaacctttctgacagggctgctgcggtgcacaacttcgggagccatcacttatttttgttgtgttccagaaggtgtcattttcatagactgcagtgtgaatagtgtcctccattaataatgcaatgatggccttgctctctgagcctcagttttatctataaaatggtacctagaagagtcatgatttcttagaatcccctaaattattaaggtgaaggtagaagatgattaaagcgtgttatctcctaagctatggcttagattttccgaagctcatggttctaggcacagaaagtctccattctacactgcatttcaacctgtgttgaacaacactccagttcagcctgtattgctatgccacatagagtttgcctgaattattatagctttcttaatagttttgtttatgatccactctctccagcccattacacaggagccagctacctaaatttcctatctgagcatgtccttacatttacttccagcatactattcatttgccatagtagagtattaagattatttgattttctttttactttctcgtagtgcccaatgtgtagtttactcaacatcataatatgtaatgtttttcaactacttactgttgaatacaaagttatctcatttaa

SEQ ID NO: 110824 - DNA, 941 bp, Homo sapiens
  Payload ID: 1740
  Gene Symbol: BTF3L4
  Gene Name: basic transcription factor 3-like 4
  ENST ID: ENST00000484036
  CDS Start-End: 73-510
ctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccaggtaagtgacatttccttagacttaagattttaagcatcctgtttatctcctttcagtcattgcatagataacttttaggtttgtgttgattgtaagctcatgaatttaaattgattcacaataatgtggataggatctaatgaaaaacaacgtaagcacccaccttagaacctagaatcagaaattgtcacacaaagctctgctgcctggatttattaaattgaaatcactgtgattataaatttgcatagctattgttataacatttctgtatgaattataattgacatatgaaaatgctattcacctcagtaatttgcatagacaaaagatgaacatttccttaggattactgtcctaagcaaataattaaatcattgttagtaaaatgccaccagttcatttctgcctccttatgttttcaggctaattctggttg

SEQ ID NO: 110825 - DNA, 892 bp, Homo sapiens
  Payload ID: 1740
  Gene Symbol: BTF3L4
  Gene Name: basic transcription factor 3-like 4
  ENST ID: ENST00000477828
  CDS Start-End: 195-359
gttggagttcagatgttcgctcccgggataggctgccccggagagggagaggcggggtcggctgtatcacgtggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaaggttttcctcacaaattcttacctgttcttccatgttggtgaatatgaatatcagctttcttattccctgtactttttaaagcctaaggaagaactagttgtgagcaactgaagtctttgattctcttcagctgtggcaccaggctcaaggagaatattctacccatatctctgcccaacacaatctttgcaaaagtgaaagaaagaatagtacttacctcagacctgaagtgggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatg

SEQ ID NO: 110826 - DNA, 794 bp, Homo sapiens
  Payload ID: 1740
  Gene Symbol: BTF3L4
  Gene Name: basic transcription factor 3-like 4
  Uniprot ID: Q96K17
  ENST ID: ENST00000489308
  CDS Start-End: 123-359
ggatctgctcccgccgccgccgccgccgccgtcgtctttctctgtctcggctgaggcagccatctttctcttgccgcgtgctggtgttggaggaccctccctgcttcagatttaccaacagcatgaatcaagaaaagttagccaaacttcaggctcaggtccggatagggggcaagggtacagctcgcagaaagaagaaggtggtacatagaacagccacagctgatgacaaaaagcttcagagttctctaaaaaaactggctgtgaataatatagctggtattgaagagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttaca

SEQ ID NO: 110827 - DNA, 2159 bp, Homo sapiens
  Payload ID: 1740
  Gene Symbol: BTF3L4
  Gene Name: basic transcription factor 3-like 4
  Uniprot ID: Q96K17
  ENST ID: ENST00000472944
  CDS Start-End: 197-499
gtctttctctgtctcggctgaggcagccatctttctcttgccgcgtgctggtgttggaggaccctccctgcttcagggtacagctcgcagaaagaagaaggtggtacatagaacagccacagctgatgacaaaaagcttcagagttctctaaaaaaactggctgtgaataatatagctggtattgaagaggtgaacatgattaaagatgatgggacagttattcatttcaacaatcccaaagtccaagcttccctttctgctaatacctttgcaattactggtcatgcagaagccaaaccaatcacagaaatgcttcctggaatattaagtcagcttggtgctgacagtttaacaagccttaggaagttagctgaacagttcccacggcaagtcttggacagtaaagcaccaaaaccagaagacattgatgaggaagatgatgatgttccagatcttgtagaaaattttgatgaggcatcaaagaatgaagctaactaaaagtttggtttttggaagctggcatggactagatttaacaaatcagctatgtggttccaaagttttacagacatggagaacatcacctgttactagttcagtaatataaatattttgtatattaataatgctgtttgttcagcatttttcggtcatttgattttgcattttgcacttcctcccaggatatttttttggtcaaaatatgaagtattggtgcagtttgagggtgttttggtttttgattcctggtttttttgttttttgtttggggtatttttggtgtatgtatgtttatgtatgtgtgtgggtatgtgtgtatacagtggagagcaaattggaaaacagttctatttatcctcctccctccccagtagaaataaaaaaaatctttacatttgttacttttcttttccccccgtaagacacagaattaatggaaagtgagtatcttggatttcaaatctgaagagatttttaccattagtggtttgattttaatttgcttggttaactatcatatttttcatacacttctctggatttaaaatatcttgaggtattttgccactggcttcatgctggagtaatgggtaacatatctttggtatggttgccttagattaacttacctagtcagacccagaagaacttcttttactagcttgcttcctaaatgccttttttcctctccttttggtctccaaatggcctggtcagcttttggtaatattcttcctcatcttccacctagcttgagaaggatgttctccatatagagtttagcgagtgcctaatccctccttttgtaagattttgttccctcagcttgaggaacaacttcatcttcaactttttatttctccctgatgttacagtttggtagatttcaaactggaatagctagcatgtgcttgctaaataattttatgccagccttatcctgtatcctagctgttcttaacagcaggtacaaaaatgcctgtttttcagcaaggttgaaattgggaatgtccttttgaatcagaagaaaataggccatagactcatctcccagcacaaatgggcattctatgaaatggtactggccctaggaggatttcctcaaccactctcctactcttggccttgaacctacctctgggttggatcttactattgtagctgctcactataccctcctgcatgcttagaataatgctttgaggggagcactggtaaaacacagtatttatttttttacctcctttaagaggacttggaggtaagttgcattcattcactcaagtttccctcttgctgtctaatagaagcttactttttgctatatcagcatttgttacagccaatatttaaggacaaaatttagaaaatatatcatttcctggcccatcatcaaactaatacagcttaaccttgcagctaccaacttttgtgtcaagctagatatctttatttgatatctaaggtgcaagaccaacaatatattaagagatctgtagacatgaaggcaaagctcttgtattttttttcatccaaacacctcaatttattttataaattcgttcatttttcctgttatgttttatataatatatggactaaacaaaataaaataacagtgcaaaagaggagaatatttcctcttgtgcttttcttg

SEQ ID NO: 110828 - DNA, 3859 bp, Homo sapiens
  Payload ID: 1741
  Gene Symbol: BIVM
  Gene Name: basic, immunoglobulin-like variable motif containing
  Uniprot ID: Q86UB2
  ENST ID: ENST00000257336
  CDS Start-End: 680-2191
agtaacgccttctccaagtggatggcggggtggacacgcgtcccggcgccccgggctccctgggatatgtagttcgcgacaggacgagcggaaatactgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggtccggagccgggttccgccgcggccgcagcgacccgaccccacccgacaggccagaggaatcagtttagacttgaaattcagtttttcctgaaactgatcagaagttagtgacaccttgattggatccgtttttctgtcaggagctcattttgcagctctcaagcttttatagcatgctgtaaacaattgtcaaagttgtttatcaagaaacagatagagttgcaacttgtttctagtaatagaaacttttacactgcattcaatgcctaacgttgcagaaacagaaaggtcaaatgattctggaaatggtgagcacaaatctgagagaaagtcacctgaagagaatctacaaggtgctgtaaaatctttctgcacaagtgcctcaggagcacccttgggtcccaaaggagatggtcattatccatggagttgtccagtgactcatacacgggaaaaaatttatgccatctgttcggactatgcctttctcaaccaggcgacctcaatctataaaactccaaatccatcccgctctccttgcctccctgatagtacctctttatctgctggaaataattcatcaagatacattggtatcccgactagtacatcggaaattatctacaatgaagaaaatagcttggaaaacttatccaacagcctgggcaagctacctctcgcatgggaaattgataaatctgaatttgatggggtgaccacaaattcgaaacacaaatcaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataagtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgttggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaa

SEQ ID NO: 110829 - DNA, 3198 bp, Homo sapiens
  Payload ID: 1741
  Gene Symbol: BIVM
  Gene Name: basic, immunoglobulin-like variable motif containing
  Uniprot ID: Q86UB2
  ENST ID: ENST00000448849
  CDS Start-End: 683-1528
agtaacgccttctccaagtggatggcggggtggacacgcgtcccggcgccccgggctccctgggatatgtagttcgcgacaggacgagcggaaatactgccaggattttaccacctctcgcccatttatttacttctcggtcaccgctttcgggggacagataaacaccacagatgcccatcaaaggggcgcacgggtctggaggcgcagctcaggtttttgcgttggtcaccctgccctccgcacgtggagagggcaggcataaagcaccttgaaaggaaggtgctgtcaatgctatccgacgacctgtcgccgggcaccgcagcatcctcgctcgctccgatgggacgagggacgccggccccagggtaacaggaggcgcctcgccggccgcgcgctggatgctgtgatccaggtccggagccgggttccgccgcggccgcagcgacccgaccccacccgacaggccagaggcaatgcaaagaaacaagtttccaagagaaaaacttcagataaaaagggaagatatcagaaggaatgtcctcagcattctcctcttgaagatattaaacagcggaaagtattagacctcagacgatggtactgcataagccgaccacagtataagacttcttgtggcatctcttcattaatttcttgttggaatttcttatacagcacaatgggagctggaaaccttccacctattacccaagaagaagctttacatattctgggctttcaacctccatttgaagatattaggtttggtcctttcacggggaatacaacacttatgaggtggtttagacaaattaatgaccacttccatgtaaaaggatgctcttatgttctatataagcctcatgggaagaataaaacagcaggagaaactgcttcaggggccctgtcaaagttaacccgtggattgaaagatgaatcgctggcttatatctatcattgccaaaatcattatttttgtccaattggcttcgaagcaacccctgttaaagctaataaagcattcagcaggggacctctctcaccacaggaagttgaatattggatcttaattggagaatcaagtagaaaacatcctgccattcactgtaaaaaatgggcagatattgttactgatctaaacactcaaaatccagaatacctggatatccggcacttagagaggggactgcagtatagaaaaacaaagaagccaacatttttttcttctcaggttgggggaaatttgcattgcatcatagcattccagagacttaactggcaaagatttggcctttggaactttccatttggaaccattagacaagaatcacaacctccaacacatgcccagggaattgccaaatctgagagtgaagacaatatttccaagaagcagcatgggcgtctgggccggtctttcagtgctagtttccatcaggactcggcatggaaaaagatgtctagtatccatgagagaaggaacagtggttaccagggttacagtgattacgatgggaatgattgactatgcttgctactgaacagctggcattatatatgaaactgctatatacaggactgtataaagacagtagaagattttagtaagcctacattaaataggagcagatcttgtggtataaaaaataaccttgtagttctccagatactaagcttgtatatgattatggtgggtgatttcagatatataagcagataagcacagattattgtcctttcaagttaagagtatataatctggacagaaaatttcacaaaattcaataaaattacaactgttgtctaaataagtgaaacacaaattcacttaatagcatcaagatttgaaatacttaagcatgaagtgacttttataatgactcgatccctagacatttgttacagatagttttatgcctaagaccaagatgtaaagtaccatctgcccttaaaaaaaattggggctgtcaatttctagttttcactcatggttaacacgcatttaaaattatttcatgagtctagtagttctttgatttatagcaggatcttgcttgcctcatttgtttcctggttatgttcttaggattctgactaagaggcaaaagagaaaagactcaagaaactgatcctggagatcgagaccatcctggctaacatggtgaaaccccgtctctactaaacatacaaaaaattagccgggtgtagtggtgggcacctgtagtcctagctactcgagaggctgaggcaggagaatggcgtgaacccgggaggtggagcttgcagtgagcggagatcgcgccactgcactccagcctgggcgacagggcaagactctgtctcaaaaaaaaaaaaaaaaaaaaagacggatccttttttttggtgcaaatgggtgacttagtgcattgattcagatttttaaaatttcttgatgtggtttgtaataatcaaatattgacaagaaccttaggtctcgaaagacttttataagtctagatgacgtttgccttaggggtaaagtaaaagaacaattggcaccttaagtttctatacccaaggttatctgtgaaatgagatctcctgatatttgattgctttctcagtatggagtcatatgttgataacagtactgaagatgcataagaaatgcccaagtcactcagaggacaactacccatattccagactctgagctgtttcctttttaaaaatcatatagacaattagctgtttgaagtgagtattaaatatttcagaagtgtgaatttcatgtatttgagctcctctagttgctgttggtttttcttctgctgccaacctgtgactcacaaatgactaggatctcttgttctttaattttagggtcttgttccaggactcaaatcagtaacttggtgattacaaggtgctgaatgtgttggtaaccatatcgcaatacacctcaaggaaaaggttcagatttttatttttaaaatattttcatttttttcttgaattttatatccgtttgttcactcgtacatgcctagcctacagaaggggatatatattatgaaatggtcatttttctgaagagaatattttgcttgaaatgcaaaggactgaaagagatttgtaggttgttgattttgttacttcatactggaacttttaaaaagatttcatcaaataaagttttgttttctacttttaatt

SEQ ID NO: 110830 - DNA, 1974 bp, Homo sapiens
  Payload ID: 1742
  Gene Symbol: BSG
  Gene Name: basigin (Ok blood group)
  Uniprot ID: P35613
  ENST ID: ENST00000333511
  CDS Start-End: 71-1228
gctttttatagcggccgcgggcggcggcggcagcggttggaggttgtaggaccggcgaggaataggaatcatggcggctgcgctgttcgtgctgctgggattcgcgctgctgggcacccacggagcctccggggctgccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccc

SEQ ID NO: 110831 - DNA, 1616 bp, Homo sapiens
  Payload ID: 1742
  Gene Symbol: BSG
  Gene Name: basigin (Ok blood group)
  Uniprot ID: P35613
  ENST ID: ENST00000353555
  CDS Start-End: 58-867
gccgcgggcggcggcggcagcggttggaggttgtaggaccggcgaggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 110832 - DNA, 1605 bp, Homo sapiens
  Payload ID: 1742
  Gene Symbol: BSG
  Gene Name: basigin (Ok blood group)
  Uniprot ID: P35613
  ENST ID: ENST00000346916
  CDS Start-End: 239-856
agttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 110833 - DNA, 545 bp, Homo sapiens
  Payload ID: 1742
  Gene Symbol: BSG
  Gene Name: basigin (Ok blood group)
  ENST ID: ENST00000573216
  CDS Start-End: 64-545
atagcggccgcgggcggcggcggcagcggttggaggttgtaggaccggcgaggaataggaatcatggcggctgcgctgttcgtgctgctgggattcgcgctgctgggcacccacggagcctccggggctgaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagct

SEQ ID NO: 110834 - DNA, 559 bp, Homo sapiens
  Payload ID: 1742
  Gene Symbol: BSG
  Gene Name: basigin (Ok blood group)
  ENST ID: ENST00000573784
  CDS Start-End: 307-559
gtgcatttgtgcaggagactgagaagggtttcttctgagcagaaagcttagcctggggcttactggccagagctgcctgcagcctgggaagcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggagg

SEQ ID NO: 110835 - DNA, 544 bp, Homo sapiens
  Payload ID: 1742
  Gene Symbol: BSG
  Gene Name: basigin (Ok blood group)
  ENST ID: ENST00000576984
  CDS Start-End: 387-544
gaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtgggccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctga

SEQ ID NO: 110836 - DNA, 1795 bp, Homo sapiens
  Payload ID: 1742
  Gene Symbol: BSG
  Gene Name: basigin (Ok blood group)
  Uniprot ID: P35613
  ENST ID: ENST00000545507
  CDS Start-End: 516-1046
cccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctca

SEQ ID NO: 110837 - DNA, 1329 bp, Homo sapiens
  Payload ID: 1742
  Gene Symbol: BSG
  Gene Name: basigin (Ok blood group)
  ENST ID: ENST00000618006
  CDS Start-End: 17-586
gcgaggaataggaatcatggcggctgcgctgttcgtgctgctgggattcgcgctgctgggcacccacggagcctccggggctgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatgatgacgacgccggctctgcacccctgaagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctcca

SEQ ID NO: 110838 - DNA, 960 bp, Homo sapiens
  Payload ID: 1742
  Gene Symbol: BSG
  Gene Name: basigin (Ok blood group)
  ENST ID: ENST00000614867
  CDS Start-End: 13-180
ggaataggaatcatggcggctgcgctgttcgtgctgctgggattcgcgctgctgggcacccacggagcctccggggctgccggcacagtcttcactaccgtagaagaccttggctccaagatactcctcacctgctccttgaatgacagcgccacagagcagcgggcagcaccagaatgacaaaggcaagaacgtccgccagaggaactcttcctgaggcaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctcca

SEQ ID NO: 110839 - DNA, 689 bp, Homo sapiens
  Payload ID: 1742
  Gene Symbol: BSG
  Gene Name: basigin (Ok blood group)
  ENST ID: ENST00000613627
  CDS Start-End: 26-689
gtaggaccggcgaggaataggaatcatggcggctgcgctgttcgtgctgctgggattcgcgctgctgggcacccacggagcctccggggctgtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaaggtggactccgacgaccagtggggagagtactcctgcgtcttcctccccgagcccatgggcacggccaacatccagctccacgggcctcccagagtgaaggctgtgaagtcgtcagaacacatcaacgagggggagacggccatgctggtctgcaagtcagagtccgtgccacctgtcactgactgggcctggtacaagatcactgactctgaggacaaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcacca

SEQ ID NO: 110840 - DNA, 4610 bp, Homo sapiens
  Payload ID: 1743
  Gene Symbol: BNC1
  Gene Name: basonuclin 1
  Uniprot ID: Q01954
  ENST ID: ENST00000345382
  CDS Start-End: 87-3071
ggcgggggcggccatcgtgctgcgcagcctgggcgcttggggagccgcccacttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacacc

SEQ ID NO: 110841 - DNA, 3169 bp, Homo sapiens
  Payload ID: 1743
  Gene Symbol: BNC1
  Gene Name: basonuclin 1
  ENST ID: ENST00000569704
  CDS Start-End: 108-3071
gccggagttcctcgggatttgtcagccagatgtgacaagattgtggcgaggcgagtgaaggagatctgatattaatcagcgcgtagctccgagccaaactttcacaaatgcggtgtagaaacatgttcttctcatttaaggcatctctttgtggctgcggggctgccaccgctccgagtctgacagctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgag

SEQ ID NO: 110842 - DNA, 4607 bp, Homo sapiens
  Payload ID: 1743
  Gene Symbol: BNC1
  Gene Name: basonuclin 1
  ENST ID: ENST00000618086
  CDS Start-End: 89-3070
gcggcgggggcggccatcgtgctgcgcagcctgggcgcttggggagccgcccacttcgccgggtcgcgccccgacggccggagcgtggatgcggcggcgcccggagccggggcggacgcggggcggccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcaca

SEQ ID NO: 110843 - DNA, 1211 bp, Homo sapiens
  Payload ID: 1744
  Gene Symbol: BNC2
  Gene Name: basonuclin 2
  ENST ID: ENST00000380666
  CDS Start-End: 328-1211
gctccaagaccggcccagacctctcgtttcatcttgccatgtcacgagtcaatgctgtgtcgtcttttcaaaaatctgcctgatttagacaagaaagaaaagtactttcatgttgcagccgcagtcccctgctaacttgtcagcagcaggatatgattcacttgggcccagaagaatggaacagagaggcgggttaggcggttcaataaagcccacggacagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcc

SEQ ID NO: 110844 - DNA, 3361 bp, Homo sapiens
  Payload ID: 1744
  Gene Symbol: BNC2
  Gene Name: basonuclin 2
  ENST ID: ENST00000380667
  CDS Start-End: 84-3182
cggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaac

SEQ ID NO: 110845 - DNA, 12844 bp, Homo sapiens
  Payload ID: 1744
  Gene Symbol: BNC2
  Gene Name: basonuclin 2
  Uniprot ID: Q6ZN30
  ENST ID: ENST00000380672
  CDS Start-End: 59-3358
gcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaagaaaaaaacatggtcttgtttttactacctgttagatatagtgctaaagaggtgctggcatgctttacagcacagatctgattttttaaaatgtcctgtactagtacataaatcccgtcatgcactttttttcatacactacaaggggatgtgtaataaccatgcttcttttttatccttaaactattgccatacttcagtaagtgtcttttttaaaaaaaattcacttgtataaaaatggtctggtcagtatagggcacaaatgccaaacaaagtattagtgttaacacaaaactgccaactttgcacaagtttccagaaaagaaaatacaattagtcactcaacataaccacaggccaatttgttggccaccagaaaaccgctttttaaaaaaacacttggtgattctttcaagtgccgaatgttattagaatcaacattgcatccttcttgcttatacgttaagttacataaaaggaaaacaaaattatgtggtgtgaaacagccaaggcatttattcttcagaggcaggataatatttcaggatacaaaagcccaaattacccgctacggaacaaagatgaatacagtaaaagagtcgaacactcatttccaaggccctaacccttatcctttaaaaagaaatcctctgaactgggtcggtctgttgtatggctgtctaatttgttgcaaattctgcagtcgtactataattcaggcctgtttggtagacaaaatcaaaaggcatttaacagcagcagtacttggaagctttgaaaacatgtgctaaacttgaatggagcaacactcctttctgaaaagccagaagaagggggttttaaagcaggatctctcaatgttcagtgttttgtgtttccccacacgatttgtcagagagaaatgaaagcaagcctgaaaccaagcaattgagagtgagaaagaggagagagactattctccaaaccttttttgttttgttttgtttccgatgtttacacatgttgcctgagctggttaaccacatcggcagcctcagctaccacaacatactgactaaatgatgatatttactcaagttcagtctgcagccaaaaccattagggtgtgcattgcagactgttttgttgtcttttttttttcttttttcctttttttttaagtggaggggaaaagaagagataaacaaggaatattttgtcaaacagtacacaataatttaaagagaatgtatttcttttttgcatttaatggcctcagacatttctttcatcagtctaaaagttagaaatatccctttattttaacttttatgtcgtttccatttttcatgtttttgtaattattttttctatgttcacatcagcattcacttccgttaaatttgccaaaggaaactgttaatatgtttctgttgttattattcctgtaggatttattgtacctcacagtatttattgtttcccaaaataagcatcattagttggggattcagtatttttgttgtgaaaatttcagaaacaatagattcttaaagataagctagctatgtctaggagctttatcttttcacctccttcagaggatgctatggggtccattttaattcttcatttgttctacggggaggaaagaccaaaagtatttgcagtacaaaagaaactatatcaaacactatgttaaatgacaagtgtttatggtaaaaagctgaggaattagtaataatcgtttttgttttcttgtactttgaattccccaaagtcttaattgctttattttggtgttgtgttaaattgaacagacagatgttttcctttgttttataccatataagactctgtacagtatgtttgtgaaagattgaactagaataatgaaagtttgtttgcaaacattttggtcctctcagcgttctctgtgttgtgctgttgccccattaccaaatggttagattcaaaaagggtgggaaaagatttttaatatcccaacaaaacattatagaaactctggcttttgcagtgtgcatagactacatgtagttttatgaaaataaatacacatttttatttcagcaactttgaaaagttacactcagttgagttactagaactcatcttgtacaacagcaatgtttagtctgtttaatttaatgtcaaataaaaggtcagatagccctcgtgagtgaattacatagctgtcggcagtcacatcagcaaatgcaccaggcttagaacaaatgtttgttacttgctgcaaaccaagctaatgtgtatagccagttagaaaaagtccagaagtaatgagattctagaagtagagtttcccttgcttggaaacatgaatgtgttcacctgtgttttgtcagagaagtggcaataagtcctggacagctgacactttttaagtatctcccctatttgctactacttttgtgcctcaagtgcccagtcgttacggtggccttctaaatgagtaaataacattttccaatataaagcctatttgcttaaaagggacaggggagtggatggatgtagtacatgcaatggaaaatcataaaatgtacaattcttctgtttccaaagtattgctcgttcttgagtgtgtgcctgagtgtcttgttttgacttaactagaattctagttaagatggtgatcccatggcttatttgcaaacaggaaggataaagagatcagcgttttagtcatggagctcatctttgcccattcctactcatttgctttttcataggagttttttgttgttaaacagtttctctcaagccacatgcattctatgctggctgaaaattaatagtgatgtagatgttcatccgacaagcttttccccatgtgattggttttagccagagtttatcacaggtacaaaattaggcggtatgactgtgcatgttctctagctgatgttgaaacttgtactgtcttgatcatttaaaactatgtttttgtaaatatcaggtttagtccgctttcgggaatatctgcatgctatggaaagagagaaaaaaaggatagataatgaggaatttggtttaaaagtgtgataaaaatccttggcattctttgttctgatattaattgtatttaaataagtcaacccaatgtaactcattccagatcttagtccagctgccctgttcagcctgatgccttttaaaggtttaaaggtgttaatgttttccttttcaacatggcaaacattttttaaaacctttttggcacaatggtgccactgtcctcatagtgttatttctttggtcatgaattttcaggcccttccagtaagaggagaaaggcacttaactggttaacagccccattattatacattgctctaaggaaaaaaaaaaaaaaaaaactttgaatatatcaagaatgggctattccagaggcttctcctcaggagaaactatgcactaggttcccaccaaatacaatgtgacctttttttcccctttctctgtacacaccccagatatgtgccaagcaaatgagaatgagggccgttgacaattaaagcataaagaagctagtcaccagattgagatggacatgctgctaactgctgacagcttgacctgagcagtcctaacttgtatctggtctgttagcattgggttagattgactaacagagtaaataaaattcacctgtcataagacacgctacatctgctatcatcaagaaacaaatcatccagaagaaactttttttcatcctgtggtcacacccttttcttaagagcttcttttttaaaattatgacaaacgaatttcattctttaaaatcacttatcttctcccaaacttgaagtatttaaattaggtggttttgcttttccctctcattgtttattttttggggatggatctaaatgagtaagatgagcaataaaagataccagaaagactggagggatcacagtgttttcatcagaactaagtagagggtcggttcctgccctggttttggggtagctagaaaaggaaatcatgaatgcactggaaatgttggctcgagagaaaagactggcatagctctgcctcgcagtgggtgagagcgtattgatcgtagggacctgcagagttcctatgaccaggtgagtcggctctgaggaaggggttaggaaagcaagtacagctgcatgaaatagctgaagttcctttggggtcaggaagagccgacaattgtggggttttggttgcttttgctttgtttttgagtgggaagtgttgctggaatcccctgagaaccgaaagatgccaggggtcagcaaggctatagaaaaggccagtggtaacacctcgttttcatcctaacagaggagtaggtgcgaatggcaccagcatggatcgttcctttcttgatcattactcatgcttgccactgtagcaacacaacaaagccatgattgtaattaatactaggctaaagaccttgatcaaaatgggagctcatttactgttctatgaggtatgtaagtaacttctcttcacattttccctcagagataaaccacacgtggtagtcttgtttgcgttagtactaaggtcatgtttgatctgtcccagacgagtcgcatatttcctgtagctggagtgttgctcaccataaatggtcattttcaaaaagtattgtgtaattccagctgtacaactgaccagtgagttatctgtcatcactgttgcccacatacccgtccttccttgtgtagtttcatcatcctcatccttcccacatcttgcgcaaaatgattttctgtgctcattcggcaataactatgttattcggcatactgtctttttggcatttgttgaaaaatccaaatgcttttaatccaaaagattaatccaaatcttttttaatccaaatgattttaatccaaatccaaataacaggaggttaaaaaaaaaaaaaaaactaagcatttttacatgtacactgaattggatcagcattattgttcattataatgctatatatatttttggagcaacatactatagttgtcataaaactatctttattcttctcctctaaagtgctgttgtaaattcatttgacctttactgcaggaaaaaaaaaaatcttttttatataggatatgaagaccaaggctcagtctgtaacaaatagtggaccattacaaaagaggaaagaaaaaagccagggctgagcagcaagaagcttcagttcaatttcacctcgtatctttctaataacatacttgtcactttattaccttccagtaatgtgaacgctgctgacaagactgtcacactaacagcagacaacaccctctctgcttcagcccagctctcctggctacttattgccctggccctgaagggacacaaactaatagtgtgctttccagttcagcacttggccatcaaatataaaaggatgcgtaattgcctgtttatccccttgtgaaggagaaattgactacaagggctaggctttcccatcgagttccctgatgtacacacacatccacaatcagtcagtctctctctctctctctctctctctctctctctctctctctctctcccctctctctctccttccctcttattctcccctcctaacatacaagcacatacacacacctactgtatctgtgggaagcccaaggctgcctctcgatgccctctccagctattaagtggacagtaacaagatgacttcttaaataaagggtcagtagagagatgctgtctgtgacggcatcctttgcttctttgaaaacttaagtgttaacaattccatcttgagagtaatgggtgtggccctataattagagcaaattttcctgcaagtcagtggcataagtaagattatattgccccctaatctgtagggaaaagattaaaatatttttcttccccttcaaaaagtgcacatgttgtaaactggttacgcacagtggtcatttttttttcttatccttggcatcaaaccatggacgtaggtgtacaaatgcatctttcaatgacccctccaaatccatagtgtaacatgatagattaacttttgtcaaactggactgacaatctaaaaaagatggcgtcaggcttttgactttaatcgttaaaacaaggaccaccctatgagtaaaaggtaaattctccactttgaagaactttggtaagtacaagtacagggagctttagaaaatcgagtgatggggaccaaaggtacaaaggaagaatacatgaaaatgttatattccaaaatgccctgagcccaaagattggctgctatttttgtatattgaaatactcaaatgatggttggaaagtgactagttagtgactaaatgaagtgcaagatctatcaagcgtcttctttctgggactaggggatgccatgcttccttccaaccttcccgcagcgcatctcagagaagatagttggccccattacaaacagtcacatttcagtaagatattagtcagccaggtaagacacgtgcaggtatcggtatcatcttccatatgaactttagcaaggagagaacagcagcagatttagggatagacaatgtaacaggtctatgttgacaaatctgtgctaaataatttcatgaaccagtgtggggactgggaagaaaagcactttgagcaaggactcttgggttcgagcaaaggcaattagttgacatgatacttcttaagttcctcagtatgtatatgttacaatcgtttatcagacatcttaatagaatcctaattgaaaaaccagttgccaaaattgcacaagttctgctcgctgatactagctttctccccttaactctaaaataccagggatgcttaaggacgtttgtaatagtttttttaatgctttgtttcacttttttaaaaaagaatctttgaagggaaggaagagcagaaagaagtattttaagaaaaatggagagaagtagatagtattgaaagtatatttcttgaagagagagtatctaagtgctataccaagattttatagggcttcctgttgccaaatgtgatgttgagataatgcacagctaagatggcaaatccatcaattattaactggctctgcccacttctgtcatggaatgcaaggattgagaggtgactctggggagaccctgggtgtgtgagagagctccattcatctggccctggatatgtttttcaaaagagagggagaaagcgccagtccctgcaaggtgaactgacctggcactgtttcagtgggagcctcactgcctgccttttccatgctaggagacaaagcatcctctaccccatctgtgaatcggtgctgtggccactgcgagaagcatgattcatgaggtatgatgctcttgagctcccagacaatgtgctgagttaataggttcacttgagatgtatacaccaaggctgtttctttttttaaatctagtccccaatttggagtatttttgcatgtttttgtacagagtaatccattcctctcattgtgtatcttaatctcctctgacttttccattgtctttctcaatcccaccctttgctcttcggatctcaccaaccccccttaaaaaataaatcatgtttgagcaagaaggtagaacacgccctccctcatcttggttttaattgctttggaaacgtgttctaccctgtccagggtttgcataacgtgaattaagtgaatgagatgttctagtattatatcttaacctgataagactatctaagatttctagtatatggtgcatttgctttcctgtgcaaactttggttcagctgccctgcagagaatctcaccattttcctgccagtgccagtataaagaatgcaggagagctaaacctgggtacatgaaggtcagaggggtgaggacggtcgagaaatggggagaagacttgggcttgagacgacctgggcttttcatgtgtagctcactcagcagtatgaggatgactgacacaccagtgggtggtttccaagtgaggcaaatgcccatttcccctctcccctcacaccttgcctggcttcttccatgaagtccttgctgcttttctgcctccccaaaggtgaggggaaggggctggttggggatctgggaaagccagttctctgttctctcctgctggtgatggactaggccttttagaactagcaagatccctcacacagctgggagaacacacacctttcttactccagacccattggtgtgtctccagtaacaaaattattggactcagcctccatatttgacagcaaaagtggccagagggagttgaaatatcttgaagaaaaggaattttcactaagatatgtcctctccctctcccagagtttagctgtttattccttttttttgtttatattgttctcatctgcataaaaccagtctcttgcaataagcctgccgcagaatcaaagtctgtacttcaaaaggtaactgcaccaagggatgggacagtgtgcatcaccctgatctaatcattgtgacgttggtagcttcctaaatactgtatgtaccttgaacaagggttttatttttgttttgttctgttttgctttttgtttttattggtaggctaaggtaattaaattttttaatttgctgttactttggttgtattttctgtactataactgcctacagtatgtcttttgcataaaatgcataagggtttggggatgtaaatggaattttattcatattttgtccaaatacctcttgtaatttgtatcaaaattcttgtacaatttttatattaaagatttatcagtcactga

SEQ ID NO: 110846 - DNA, 2106 bp, Homo sapiens
  Payload ID: 1744
  Gene Symbol: BNC2
  Gene Name: basonuclin 2
  ENST ID: ENST00000411752
  CDS Start-End: 1-984
ccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctccgaagaggaaattctaaccggcctggaacctgctgtcttcatacgggagattctcttgaagagagcgtgatagtcagaattagctgcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 110847 - DNA, 3673 bp, Homo sapiens
  Payload ID: 1744
  Gene Symbol: BNC2
  Gene Name: basonuclin 2
  ENST ID: ENST00000418777
  CDS Start-End: 1-2583
tcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctcctgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaa

SEQ ID NO: 110848 - DNA, 4841 bp, Homo sapiens
  Payload ID: 1744
  Gene Symbol: BNC2
  Gene Name: basonuclin 2
  Uniprot ID: Q6ZN30
  ENST ID: ENST00000484726
  CDS Start-End: 113-2824
gagagaaaggccgagacggagggagccagcggcggccgaggggctggtccaggcgcggccgctaagaggagaccaagaggcgggggctgcacttgacaaccagcatgccgagatggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagatactgggagaagagcaatgagcaaaacggtctccttgtatcatggggagagactctgtcaagcctaaagtgagcctcggatcttcctaatgacctcctgctggcccagctggatgcaagacaagctcgtttaagcctctgctgacctttcactcctccactacaagaactgcaccactcatttccaccgtcttcagaactgtgcaccaaatagaccacaaagcttcatggctgacgaatgatttccttttcatgatgcaaagagatttttacaaatttctattgatgagagttaacattaagtctcttgtggcattataacctctgttgcacaaatacaatgcttctatataactcttatttttaccttccttataaaggaacaatctactgttcttgccagcattatcttgaaaattcaggccaaaatatctgagcagaatgcacatactgagtgcaccggtggtatttttcatgaagagaccactttgaaagggtcttcctgatttccacctccctcagaatctatctgaccttctcacagactttattggtgtgaatctttcttatatttaaccatttatttgagatgctcatttttgtagcccatcttttctttttaaaaaacatgggctggtttctacccagaagagggtggtaagactgtacatgtacgttaacattcacttgtataactcagcaaaagattagaaagctgatcttattgtcacaagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaaga

SEQ ID NO: 110849 - DNA, 3750 bp, Homo sapiens
  Payload ID: 1744
  Gene Symbol: BNC2
  Gene Name: basonuclin 2
  ENST ID: ENST00000545497
  CDS Start-End: 496-2685
agacggagggagccagcggcggccgaggggctggtccaggcgcggccgctaagaggagaccaagaggcgggggctgcacttgacaaccagcatgccgagatgtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgcttccattccagtacataaaccctgtctcagcaccactgctagggttgcctccaaatgggctactgttagagcaaccagggttgaggctgcgggaacccagcctttcaactcagaatgaatataatgagagcagcgaatccgaagtttctcccacaccttataagaatgatcaaacacccaatagaaatgccctgaccagcattactaatgtggagcccaaaaccgagccagcctgtgtctctcccattcagaattctgccccagtcagtgatctaaccaaaactgaacacccaaaaagctcattccggattcatcggatgagaaggatggggtcagcctctaggaaaggaagagtgttctgtaatgcatgtgggaagacattctatgacaaaggtactctcaaaattcattacaatgctgttcacctgaagatcaaacatcgatgcaccattgaaggttgcaacatggtctttagctccctccgaagtcgtaatcgccacagtgcaaaccccaatcctcgccttcacatgcctatgctaaggaataaccgagataaagatttaattcgggccacctcaggagctgccacccctgtcatagcaagtacaaaatcaaatctggcactcacaagccctggccgacccccaatgggttttaccactccccctctagaccctgtcttgcaaaatcctctccctagccagctagtattttctgggctaaagactgtacaaccagttcctccattttatagaagtttactcactccaggggaaatggtgagtcctccaacctccctcccaaccagtcccatcattccaaccagtggtaccatagagcagcaccccccgccaccctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagaaacagaaatttacggatggaaagaaccataggtccaggacatcgagacagcctgcatctcctgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttggggtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacagtgtgcaactagccccagttttgacagaataattcttggtcttccccaaagagacaatttgttgtacccatgactgttgcctgcaaaaataaaaggg

SEQ ID NO: 110850 - DNA, 545 bp, Homo sapiens
  Payload ID: 1744
  Gene Symbol: BNC2
  Gene Name: basonuclin 2
  ENST ID: ENST00000603313
  CDS Start-End: 181-545
agctgttaaactgagcaaaggcaagcttggggagtcacaatctatgcataaatgatagggatatctgtgcagaagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaaga

SEQ ID NO: 110851 - DNA, 1008 bp, Homo sapiens
  Payload ID: 1744
  Gene Symbol: BNC2
  Gene Name: basonuclin 2
  ENST ID: ENST00000603713
  CDS Start-End: 274-1008
aaatgatagggatatctgtgcagaaggtgcgaaagaagctctgaccccctccctcccccaaatctcccccttcccaaatgaaatgcacagttcagccagcttcttaactacactacactcctgctactggctgccaagaggctcaaaaaatccaccttcacttttcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgcacggccttggctggactctgcgggactatgtccgaggatacatccttcaggatgctgctggcaaggtgctggaccgctgggccatcatgtctcgagaagaggaaatcatcacccttcagcagtttctgcggtttggagaaaccaaatccattgtggagctgatggcaattcaggagaaagaagggcaggccgtggctgtaccatcttcaaagacagactcagatataaggactttcattgagagcaataatcgcaccaggagtcccagcctccttgctcacttagagaacagcaatccttccagcattcatcacttcgaaaacatcccaaacagccttgcatttctgctt

SEQ ID NO: 110852 - DNA, 662 bp, Homo sapiens
  Payload ID: 1744
  Gene Symbol: BNC2
  Gene Name: basonuclin 2
  ENST ID: ENST00000468187
  CDS Start-End: 1-330
tcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttagaaatttgttgacctcctttcttgaataaattatccttgttaacagca

SEQ ID NO: 110853 - DNA, 688 bp, Homo sapiens
  Payload ID: 1744
  Gene Symbol: BNC2
  Gene Name: basonuclin 2
  ENST ID: ENST00000486514
  CDS Start-End: 196-688
ggggccgcggcgagggcgcgcgcgggcgggcggggaggcggaggcggcgagagcggaggcccggaggaactcggagggggagggagagaaaggccgagacggagggagccagcggcggccgaggggctggtccaggcgcggccgctaagaggagaccaagaggcgggggctgcacttgacaaccagcatgccgagatgtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactgcacatgtgaatgttttcagccagggaagattaacctgaggacttgtgatcagtgtaaacatggctgggtggcacatgccttggataagctcagcacgcagcacctgtaccaccccacccaagtggagattgtgcagtccaacgtcgtgtttgacatcagcagcctgatgctctatgggacacaagcagtgcctgtgcggctaaagatcctgctggaccgtctcttcagcgtcctgaagcaagaggaggtactgcacatactgc

SEQ ID NO: 110854 - DNA, 745 bp, Homo sapiens
  Payload ID: 1744
  Gene Symbol: BNC2
  Gene Name: basonuclin 2
  ENST ID: ENST00000471301
  CDS Start-End: 328-459
ccactagcatgaagctgatttgctgtgatggtcacttagaagggtttcgctttttcctaaactgtggctgtttaaagtcttggagtctggacaattaacagctgaagaaaatatgacaagacacacgcaaagaggttgggagatagagaggaggagtgcgccagaaaggagctgagctgccttcttgtgtaaactgcctgagagcgggccccctcccctggcctccgtccctgtccccccttccccaaggctgtgttctgctgtctgcccgaaggccaggactgatctgttaaccttgcaccactggctgggaggccgctgcagctcatggccatccgttgcacactggtaaactgcacatgtgaatgttttcagccagggaagattaacctgaggacttgtgatcagtgtaaacatggctgggtggcacatgaaaccctgaaatcgtgtctccaatgacttctgctcagaggtgaaacacagcattctttccggctgccttatactgtgcagtgtcctgggtgtggggcaatgaggaagtgacttgggttttctagtgtgtaattttcctctgaaatgcatggaacagcaacaaaactaccaagatacattgcccagaatggtttcatggtagcactgaatgcattctacctgtcattatgtcaataaaaaaatttttaatatctgctgctaaaaaataaccaaatgccaaaatcatgtattctctctaaaacagatttttaga

SEQ ID NO: 110855 - DNA, 561 bp, Homo sapiens
  Payload ID: 1744
  Gene Symbol: BNC2
  Gene Name: basonuclin 2
  ENST ID: ENST00000613349
  CDS Start-End: 440-561
tagagggagctattctttttgttgttgttcctgggaatatttcttatattaagggagtccaaaatagatgatgacttgaagttagtggtttcctttacttttaattttacagttaagggttcagcacggttttaaatattccttaagtatttgaaagatggccttagtgaatatgaggagttcaatttagtactgttcacattcacttgtttgagatgatttgccagttgacaatgtggcttttatggttattgtaagatggcatacttcaactgtattatttatagtcttctaaacaacctacgatccccaaatatccaatactaaattgcagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactg

SEQ ID NO: 110856 - DNA, 687 bp, Homo sapiens
  Payload ID: 1744
  Gene Symbol: BNC2
  Gene Name: basonuclin 2
  ENST ID: ENST00000617779
  CDS Start-End: 566-687
tagagggagctattctttttgttgttgttcctgggaatatttcttatattaagggagtccaaaatagatgatgacttgaagttagtggtttcctttacttttaattttacagttaagggttcagcacggttttaaatattccttaagtatttgaaagatggccttagtgaatatgaggagttcaatttagtactgttcacattcacttgtttgagatgatttgccagttgacaatgtggcttttatggttattgtaagatggcatacttcaactgtattatttatagtcttctaaacaacctacgatccccaaatatccaatactaaattgcaggcacaccttgggcccaccccacctccacatagccttaattacaaatcagaggacaggcttagtgagcaagactggccagcatatttcaaggtcccatgttgtggggttgatacatctcaaattgagtcagaagaggcagaagtggatgtgagagaaagagagacacagagagacagagagccaaagagggcaagagacttgactttaagagactcctgtactgacaactccatgcagttcggaaccagaacgactacggctgaaccagggttcatggggacatggcaaaacgctgatactaacctcttattcagaatgtcccaacaggccatccgttgcacactggtaaactg

SEQ ID NO: 110857 - DNA, 15955 bp, Homo sapiens
  Payload ID: 1745
  Gene Symbol: BSN
  Gene Name: bassoon presynaptic cytomatrix protein
  Uniprot ID: Q9UPA5
  ENST ID: ENST00000296452
  CDS Start-End: 115-11895
gagccgagctgggagatggcggcggcagcggcggcgccgagagtgtgagcaccgcccgggagccgccggcccgggcgcagcgcgaccccgaccccgcccgcccgcctgcccgccatgggcaacgaggtcagcctggagggcggcgctggcgacgggccgctgccgcccggcggcgccggccccggcccgggccccggccccggccccggcgcaggaaagccgccttcagcaccggccggtggcggacagctccccgcggcgggagcagcgcggtcgaccgcggtaccaccggtccctggccccggccccggccccggtcccggccctggcccgggcagcacttcccggagactggaccccaaggaacccctgggtaaccagagagcagcttccccaactccgaagcaggcttctgctaccactcctggccatgagagcccccgagagacaagggcacagggaccagcaggccaggaggctgatggtccccgcaggacgctgcaggtagacagcaggacacagagatcagggcggtccccctcagtgtcaccggacagaggcagcacccccacatcaccctactccgtccctcagatcgccccccttcccagcagcacgctgtgtcccatatgcaagacttcggacctcacgtcgacccccagccagccaaacttcaacacctgcacccagtgtcacaacaaggtctgcaaccagtgtgggttcaaccccaaccctcatctcacccaggtgaaggagtggctctgtctgaactgtcagatgcagagggctctgggaatggacatgaccactgcacctcgctccaagagccagcagcagctgcactccccagccctgtctcctgcccactccccggccaaacagcccctggggaagccagaccaagagagatctcggggcccaggaggaccacagcctgggtcccgccaggctgagacagccagggccacctcagtgccggggcctgcccaagcagctgcccctccagaggtggggagggtgtctcctcagccccctcaacccaccaagccttccacagctgagcccaggccacctgcaggagaggccccggccaaaagtgccaccgcagtgcccgctgggcttggtgccactgagcagacccaggagggcctcactggtaagctcttcggccttggcgcgtcactgctaacccaggcgagcaccctcatgtctgtgcagcccgaggctgacacccagggccagcctgcccccagcaaggggacacctaagatcgtcttcaatgatgccagcaaggaggctggcccaaaacccttgggctcagggcccgggcctgggccagcacctggagccaaaactgagcctggggctagaatgggtcctggatctggacctggagccctgccgaaaactgggggaacaaccagtccaaagcatggcagagcagaacatcaggcagcatcgaaggctgctgccaagccaaagaccatgccgaaggaaagggccatctgcccactgtgccaagccgagctcaacgtgggcagcaagagcccagccaactataacacatgcaccacctgcaggctccaggtgtgcaacctgtgtggcttcaacccaacaccccacctggtggagaaaacagagtggctctgtctgaactgccaaaccaagcggctactggagggcagcctaggagagccgacccccctgccgccgcccacctcacagcagccccctgtaggggcccctcaccgtgcatctggaacatcccctctgaagcagaaagggccacaggggctgggccagccttcaggccccctgcctgccaaggccagccctctatccaccaaggccagccctctgcccagcaaggccagcccccaggccaagcccctcagggcttctgaacccagcaagaccccaagcagtgtccaggaaaagaagacccgagtccccactaaagctgagcccatgccgaagccacctccagagactaccccaacccctgcgactcctaaagtaaagagtggggtgaggagggctgaacctgccacccctgtcgtcaaggctgttccagaagcccccaagggtggggaggcggaggacctggtgggcaagccttactctcaggatgcgtctcggagcccacagagcctcagtgacacaggctattcctctgacggcatctctagctcccagagtgagatcacaggagtcgtgcagcaggaggtggaacagctggacagtgcaggggtgacagggccacatccacccagcccctccgagatccacaaggtggggagcagcatgcggcctttgctgcaggcccagggcctggccccaagtgagcggagcaagccactctccagcggtactggcgaggagcagaagcagcggccccactccttgtccatcacgcctgaggcctttgactctgatgaggagctggaggatatcctggaggaagacgaagactctgctgagtggaggcgccggagagagcagcaggacactgccgagtcctcagacgactttggcagccaattgaggcacgactatgtggaggacagcagtgagggtggcctgtcccctcttccaccccagcccccagcccgggcagcagaactgactgatgaggatttcatgcgacggcagattctcgagatgagcgccgaggaagacaacctggaggaggatgacactgccacctccgggcgtggcctggccaaacatggcacccagaaaggtggccccagacccaggcctgagcctagccaagaaccagcagcactgcccaagaggcgcctgccccacaatgccaccacgggctatgaggagctgctccctgagggaggctcagcagaggctaccgatggcagtgggaccctgcagggtgggctccgtcgcttcaagaccattgagctcaacagcacgggaagttatggtcatgagttggacctgggccaaggcccagaccccagtctggaccgggagcctgagctggagatggagagcctaacgggctcccctgaggaccgctcccgtggtgagcactcctctacattgcctgcctccacacccagctacacctcgggcacctctcccacctctctgtcctccctagaggaggacagtgacagcagccccagccgcaggcagcgtctagaagaagcaaagcagcagcgcaaggcccggcaccgctcccacgggcccctgctacccaccatcgaggactcctcagaggaggaggagctgcgggaggaagaggagctgcttcgtgagcaagagaagatgcgggaggtggagcagcagcgcatccgcagcacggcccgcaagacccggcgggacaaggaagaactgcgggcccagcggaggcgagagcgctccaagacaccacccagtaacttgtcacccatcgaggatgcctccccgacggaggagctgaggcaggcggccgagatggaggagctacaccgctcctcctgctctgagtactcaccctcaccctcccttgactctgaggctgaggccttggatggtggccctagccggctttacaagtcaggcagtgagtacaacctgcccaccttcatgtccctctactcaccaaccgagacaccctccggcagctccaccactcccagttccggacggccgctcaagagcgctgaggaggcttatgaggagatgatgcgcaaagctgagctgctccagaggcagcaaggccaggcagcaggggcccggggaccccatggcggcccctctcagcccacaggcccccggggcctgggctccttcgaatatcaagacactacagaccgtgagtatggccaggctgctcagcctgccgcagagggcacgccagccagcctgggagcagccgtgtacgaagaaatccttcagacatcacagagcatagtccgcatgcggcaggcctcctcacgagacctggcttttgctgaggacaaaaagaaggagaagcagtttctaaatgctgagagtgcatacatggacccaatgaagcaaaatggtggcccccttacccctggtaccagtcccacccagctcgctgcccctgtgtccttctctacccccacctcctcagacagcagcgggggccgagttattcccgatgtccgtgtcactcagcattttgcaaaggagactcaggaccccctcaagctgcacagctctcctgcctcccccagctcagcctccaaggagataggcatgcccttttcccagggccctgggaccccagccaccacagctgtggctccttgtccagctgggctgccacgaggatatatgactccagcctccccagcaggctccgagcgtagtccttcaccatcttccacagcccacagctatggacacagcccaaccactgcaaactatgggtcccaaactgaggatctaccccaggcccccagtggccttgctgcagctggacgagctgctagagagaagcccttgagtgcgagtgacggtgagggtggcactcctcagccttcccgggcatattcctactttgcaagctccagcccacctctctccccgtcttccccctcagagagtcccacattctcccctggcaagatgggcccaagggccacagcagagttctctacacagacgccaagtccagcccctgcctcagacatgccacggagccctggtgcccccactccatcacctatggtagcccagggtacacaaacaccacatcgacccagcacgcctcgcctggtgtggcaggagtcctctcaagaggctccctttatggtcatcacgctggcatctgacgcctccagccagaccaggatggtacatgccagtgcctccacctccccgctctgctcacctactgaaacccagcccaccacccatggctacagccagacaacacctccgagtgtgtctcagctgcccccagagccacctgggccacctggctttccacgggtgcccagtgctggtgcagatgggcccctggcactatatggctggggtgccctccctgctgagaacatctccctgtgccggatctcctctgtccctgggacgtctagggttgagccaggccccaggacccctggcactgcagtggtagacctccgtacagctgtcaagcccactcccatcatcctcactgaccagggcatggacctcacctctcttgctgtggaagcgaggaagtatggtcttgccctggatccaatcccaggacggcagtcgaccgccgtgcagcccttggttatcaacctcaatgcccaggagcataccttccttgctactgccaccaccgtgagcatcaccatggcctcgtctgtgttcatggctcaacaaaagcagcctgtggtctatggagacccctaccagagccgccttgactttggccagggtgggggtagccctgtgtgcctggcccaggtcaaacaagtagagcaggctgtccagacagccccataccgaagtgggccccggggaagacccagggaggccaagtttgccagatataacctacccaaccaagtagctcctctggccagaagagacgttttgatcactcagatgggcaccgcccagagcattggcctcaagccaggcccagtgccagagccaggtgccgagccccaccgggccacccctgcagagctgcggtcacatgctctgccaggtgccaggaagccacacacagtggtggtgcagatgggagagggcacagcaggcactgtgaccacactgctcccagaggagcctgcgggtgccctggaccttaccgggatgaggcctgagagccagctggcatgctgtgacatggtctacaagctcccctttggcagcagctgcactggcaccttccacccggcccccagtgtgcctgagaagagcatggcagatgctgccccacctggccaaagcagcagccccttctatggtccccgggaccctgagcctcctgagcccccaacctaccgggcacagggggtggtggggcctgggccccatgaggagcagaggccctacccacaaggcctgcctggtaggctgtactcctccatgtctgacaccaatttggctgaggctggcctcaactaccatgcccagaggatcgggcagctcttccagggtcctggacgagactcggctatggacctcagctcactgaagcactcctacagcctgggctttgcggatggacgctacctagggcagggcttgcagtatggctcagtcacggacctgcgtcatcctacagaccttttggctcacccgcttcccatgcggcgctatagctcagtgtcgaacatctactcagaccacaggtacggcccacggggagatgcagttggcttccaggaggccagcctggcccagtacagtgccaccacagcccgtgaaatcagtcgcatgtgcgctgccctcaactccatggaccagtatggtgggcggcatggcagtggtggtggtggccctgaccttgtgcagtaccagccccagcacgggcccgggctcagtgctccacagagtctggttcccctcagacctggactccttggtaaccccacctttccagagggccacccaagtcctgggaacttggcccagtatgggcctgcagcaggccaaggaacagcagtcagacagctgctgccgtccacagccactgtacgtgcagctgatggcatgatctactcgactatcaataccccaattgctgcaacactgcccatcaccacccagcctgcctcagtcctgcggcccatggtgcgtggtggcatgtacaggccttacgcatctggtggaatcacagccgtgccactcaccagtctgacacgtgtgcccatgattgccccccgggtacctcttggacccacagggctgtaccgctatcctgcaccaagtagatttcccattgcttccagtgttccacctgcagaagggcctgtctatctggggaaacctgctgctgccaaggcccctggggctgggggcccttcaaggccagagatgccagtaggggctgcacgggaagagcctcttcccacaaccacccctgctgccatcaaggaggctgcaggagccccagctcctgccccactagctggccagaagccaccagcagatgctgctcctgggggtggcagtggggccctcagccggccagggttcgagaaagaggaagcatcacaggaggagaggcagcggaagcaacaggagcagctgctccagctagagcgggagcgggtggagttggagaagctgcgacaacttcggctgcaagaggagctagagcgggaacgtgtggagctgcagaggcaccgtgaggaggagcagctgctggtgcagcgggagttgcaggagctgcagaccatcaagcaccatgtgctgcagcagcagcaagaggaacgccaggctcaatttgcactgcagcgggaacagctagcgcagcagcgtctgcagctggagcagatccagcagctgcagcagcagctgcagcagcagctagaggagcagaagcagcggcagaaggctccctttcctgcagcctgtgaggcacctggccgagggcctcccctagcggctgctgagttggcccagaatggccagtattggcccccccttacacatgcagccttcattgccatggcagggcctgaaggacttgggcagcctcgtgagcctgtgctgcaccggggtctccccagctctgcctcagacatgtcactgcaaacggaggagcagtgggaggccagccgtagtggcatcaagaagcggcactccatgccacgcctgcgggatgcctgtgagctagagtctgggactgagccctgtgtggtcaggaggattgccgacagcagcgtgcagacagacgatgaggatggggagagccgctacctcttgagtcggcgacgccgggcacggcggagtgctgactgcagtgtgcagacggacgacgaagacagtgctgagtgggagcagccagtgcgccgccgcaggtctcgtcttccccgccactcagactcaggctctgacagcaagcacgatgccactgcctcatcatccagtgctgctgccactgtgagggccatgagcagcgtgggcatccagaccatcagtgactgctccgtgcagacggagcctgaccagctgcccagggtctctccagccatccacatcacagctgccaccgatcccaaggtggagatcgtcaggtacatatcggcgccagagaagactgggcgtggggagagcctggcctgccagacggagccagatgggcaggcccagggtgtagccgggccgcagcttgtagggccaactgccatcagcccctacctgcctggcatccagatcgtcaccccagggcctctgggcagatttgaaaaaaagaagccagatcccctggagattgggtaccaggcccacctgcctccggagtctctctcacagcttgtgagccgccagcctcccaagtcccctcaggtcctctactcaccagtctcacccctgtcccctcaccggctcctggacacctcctttgcttccagtgagaggctgaacaaagctcacgtgagtccccagaagcacttcacggctgacagcgctctccgccagcagacgctgcctcgccccatgaagaccctgcagcggtccctgtctgaccctaagcccctcagccccaccgccgaagagtctgccaaagagagattctccctctaccagcaccaggggggactgggtagccaggtgtcggcgttgccacccaacagcctggtccgcaaggtgaagcggacactgcccagcccccctccagaggaggctcaccttcccctggctggccaggcctccccacagctgtatgcagccagcctgctgcagcgagggctgacggggcccaccactgtccctgctaccaaggccagcctgctccgggagctggaccgggacctgcggctggtggagcatgagtccaccaaactgcgcaagaagcaggcagagctggatgaggaggagaaggagattgacgccaagctcaagtacctggagttgggtatcacacaacgcaaagagtctttggccaaagaccggggtggccgtgactacccacccttgcgtggtcttggcgagcatcgtgactacctatcggacagtgagctcaaccagctgcggctccagggctgcaccactcccgctggccagtttgtggacttccctgccactgccgctgctcctgccaccccctctggtcccactgccttccagcagccccgcttccagcctccagccccacagtattctgcaggcagtggtgggccaactcagaacggattcccagcccaccaggcccccacctaccctggccccagcacgtacccagctcctgcctttcctcctggtgccagttacccagctgagcctggcctgccaaaccagcaggctttccgccccacaggccactatgcaggccaaacacccatgccaaccacacagagcaccctttttccagtccccgctgatagccgtgccccactgcagaagccacgccagacatcgctagccgacttggagcagaaggtgcccaccaactatgaggtgatcgccagccccgttgtgcccatgtcttcagccccatctgaaaccagctacagtggcccagcagtgagcagcggctatgagcagggcaaggtccctgaggtgccccgggctggtgaccgtggcagtgtgagccagagcccagcccccacctacccctctgactcacactataccagtctggagcagaacgttcctcgaaactacgtaatgattgatgacatcagtgaactgaccaaggacagcacctctactgctcctgatagccaacggctggagcccctggggccaggcagcagtgggcgtccagggaaggagcctggagaaccaggtgtccttgacgggcccacactgccctgctgctatgccagaggagaagaggaatctgaggaggactcatacgatccccgcgggaagggtggccacctccggagcatggagagcaatggtcgaccagccagtacccactactatggtgacagtgactacaggcatggggctcgagtagagaagtatggtccagggcccatggggcccaagcatccctccaagagcctggctccagctgccatctcctcaaagcgcagcaagcaccggaagcagggcatggagcaaaagatatccaagttctcgcctattgaagaggccaaagacgtagagtcagacctggcgtcctaccccccacctgcagtcagcagcagcctggtctctcggggcaggaagttccaggatgaaatcacctatgggctcaagaagaacgtgtatgagcagcaaaaatactatgggatgtccagccgggacgcagtggaggacgaccgcatttatggcgggagcagccggtcccgggcaccttctgcatacagtggggagaagctgtccagccacgacttcagtggctggggcaaggggtacgaaagggaacgggaggctgtggagcgacttcaaaaagcgggccccaagccctcatccctaagtatggcccacagccgggtacgaccccccatgcggagccaggcctctgaagaggagagccccgtcagtcctttggggaggccccgccctgccggagggcccctccctcccggcggggatacctgcccacagttctgctccagccactccatgcctgatgtccaggaacatgtcaaggacggacctcgggcccacgcatataagcgtgaggagggctacatcctggatgattcccattgcgtggtttccgacagcgaagcgtatcacctgggccaggaggagacggactggtttgataagccccgggatgcccgctctgaccggttcaggcaccacgggggccatgcagtttcctcctcctcccagaagcgaggccctgccaggcacagctaccatgactacgatgaaccccctgaggagggcctgtggcctcatgatgagggtggcccaggccgccatgcctcagccaaggaacaccggcacggtgaccacgggcggcactcaggccgccacactggtgaggagccgggacggcgtgctgccaaaccacacgctcgggacctgggtcgccatgaggcccggccccactctcagcccagctctgctccagctatgccgaagaagggtcagcctgggtatcccagctctgctgagtactcacagccatcccgtgcttcatccgcataccatcatgcctctgacagcaagaagggctcccggcaagcccactccgggcccgctgcactgcagtcaaaggcagaaccccaggcgcagccgcagctgcaaggtcggcaggcagctccaggaccacagcagtcacagtcaccatcatccaggcaaataccctctggggcagcatcacgccagccacagacacagcagcagcagcaaggtcttgggctgcagcccccacagcaggctctgacacaggctcggctgcagcaacagagccagccaaccacccggggctcagcccctgctgccagccagcctgcagggaagcctcagccaggccccagcacagccacaggtcctcaaccagcaggaccgccacgggcagaacagacaaatggctctaaagggacagccaaagcaccgcaacaggggagggctcctcaggcccagccagcaccaggacctggacctgcaggtgtgaaggctggagccaggcctggaggaaccccaggggctcccgccggccagccaggtgccgatggggagagcgtgttctccaagatcctccctggcggggcagccgagcaagctggcaaactgacggaagctgtctctgcttttggcaaaaaattttcctcattctggtgaccatgcccagcatggctcttgaagaaatgaagagaggtatcattgctgtggaaaaatctctggagtcagaggcctgggcgcagctctggactctgcgtataacacatctacaatctggcaaacccttggcccaaagactcaccaggtgggacgtggcaggcaggcctcagttgaggacgtgatgttttctcacagcagctgcctgggtgaagcatctgctggacaagtcggaccactggccaggggacctttgattgtctttccagagatgctgctctctgcagggcaccaccttcaaggcacagcccttgttgggagggagaaccctctccagaaaccctgccaccatggtgtcttgccgtacttcccacagccgcctttttgcggcctggccggccaggcttcccgtgcgttatacacagagtttgggcacacactgccctccctccgagatgccagaagtttttccacagccttggagaggggctttgactgagggctgggggccctgggctccgtttccttcacattccagctggcccggatccctctgtggcacagggccctgcccgtcacatgccctctgggtgacatcggagcagacctccatgtggccaggggttgggagaactttacaaacattaggacctaacactgtctcatcgctgaaataagaggccatagcaccgaaaagcagcgtgggcgccggctgaggcttctcccagcccgtgggtggcagcgtgctagcacactgccaccatctcaaagccatccccctagccatcgtgagcatcccagcggcaccgccattgtctcaaccagccggctcctcgtctgtacacctggggatttcttttgatttcaagaacagccttaatcattccagtttgatttacgtgtatacctcataaacatttttcttttgtttctctctccccctttctctcttctcttggctcactcccttgcctctccccctccaccaccaccttgtgactgatggtttggtttcctctctgctctgcccctgctcagcacagggagaatgttgacttagaagcaatagggggcagcaggccaccaagagcacaaccccagggcgaggtctggggaggcctcccagcccgcctctgtttactgtgcaattccagtcgttcttaagccatcaccagtgggtgtactcagagcagaggggccaggacttctgccagccaagggaaaggcccagagccctgtgcgggggaatgtggcactgtctatccatccggtggactgggcagcattcctccccagggctcttcccttgggggcctcctttcatctggggcacagccacaagtctcatctctaacgttctatgcaatgaaatataaaccctcaatgacaactgttaatatttaataaattccatgttatgtataaggagttaattgcaaacatgcaattgagaaactggatagatacactcataaaacccccacccctccccaccccacccctgctcccattgtgtgtgtgaaattctcagtctgtggcatgtttgacctgtggcaggactcgctgctgccaggtgagtcaccgcctgtcctgcagtggagcatgcacagctcgcagcctctttgcacgatttcatccattttaaatgcttgaccctcttgcttggagttctttttgcctcagaacctctccttcaggagcacttctagctgacttctgcacaagctagtgaggacctgccagaattgttgcctgagcgtgccaggctgcagggcaggcagtaaaaggcccccacataccctgcagttttctctgtccaggacagcaggtaaaaaggaatccccagagcagacgcaatggtaggagcctgcacaggatgtgtgtgtatggacattctgaaggtttgctgtaggatatctgtctgtctgtcattttcccttcctaccccaaccctgagccagaggcatctgacagccctttcccagagggcaccacgcaagggcagagctgggcggcatccacagccagagaggcagaggcaagagcagagccaggctgtgcccgagggaccccagctcttgactgcacctgtttcatgcctctcctctgtggctaggaggctcaaaggactgtgagccaggagatctgggctggagctagggggtcaatggatgctcaggaagagctgggcctttggcacttgtggtgagaacagttgacagtggtcatctggaactgttcatataaacagtggcttcaagctaagtttcttgtgaagtttctcaatagcaaatcttacagaaggtcctgtgtgaccctctctgcatctgtccccaggacctatgctccctgctcacccccttctccaaagcccaagcgtcccgctgctcatcagcttttttaccattgagccaggagtgcggcaggcagtacctgcctgacccttcaaggcctgaccttcgtccagagtgctctggtttgcaccatgcatttctcaggggtccgcatttctcatgcttttctataagatctacacaccccttcagagagggctcctcgctcacctctggtagctatggatgggacaggaagctgccaacctttgtgttggacttaacacccttgcctttctgggacttggcctcaccccacccatggaatacctgcctcatcccaaagatcaggtatgggctgaatgcagccatctgagcaagggctgagggaagccatcacctaacacctctggccacccaggaccaggtctgtgtggggatgtgccttggagaccaaggcaatagtcctttccactacaggccaggggatgggacaagaagtagggaacaggcagggaaatgttaggaggtcagcctccagcaggcctagtctcaggctctaaagtactgacttttcagcaaatttcctttctggccaagccctctgagtttgaaattctgacatctgccactcctcatcccccactgtacccacaggatacatcatcgcccctctgtgaaggtggctggagcaggcctctggtccatggactgtccttcctggcccttgcatggatgcagttgtgactctggggacaatgcagccagaagctgagggaccagcacttggtgccttggaaagtagagagcaacagacacatctccaaatgggcaaggagtctctagcatgcagcccaggccttctccatacccctctccccagcatcatgagcaagggcattgcctcctctctctgctcacttcagggcccagtgcactcacttcacagtgacagccctcccctacaatccttgggcagagcatgtggtctgagggcccacagtgaaagaacagcagtggtggcaactatgccttgccttctggagcctgtagggagttttccaggcaggtcctttgccaggacagcatggtcctgccctgttgtcccgtctgctctcctcttacccacccccatgctgtaaatacttgtcatcatggactccaacagggttagagggacaggcctaatcaactgaaactcctcggagatgccatctctgtctccctgggtgccagcagccctgctgccatgtgcactggggtggcactggagagccatggcagtcgtgagatattgtatgtgtatgcacatgatcatgtgtgtatgtgcgtgcgtgcgtgcgtgtgtgtgtgtgtgtgtgtttctgcctcattcagtttctggggtcaaatcagctccttctctccaagtgcactaccctggagagtggtggccactcaataccttttcctctagctttcatgtcttgtttttgctttccccttcctcctccctctctccctttctttccttctctccttctttatttgaggggggaagagtgctgtacaaagtcaaacaaacaagtttacagttgtaagtgcaatgacccgagtcctccacatgaccttgtgaattgtgtgctgtccttctgtgctctgtgagaactcgtggtacttcagtgtccctccccctgtattgtgacaaggtaattctgtggtatcagaataaaaggacttgatataaacaa

SEQ ID NO: 110858 - DNA, 2339 bp, Homo sapiens
  Payload ID: 1746
  Gene Symbol: BSPRY
  Gene Name: B-box and SPRY domain containing
  Uniprot ID: Q5W0U4
  ENST ID: ENST00000374183
  CDS Start-End: 40-1248
acctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagcattgaagattta

SEQ ID NO: 110859 - DNA, 383 bp, Homo sapiens
  Payload ID: 1747
  Gene Symbol: BBIP1
  Gene Name: BBSome interacting protein 1
  Uniprot ID: A8MTZ0
  ENST ID: ENST00000436562
  CDS Start-End: 40-252
ggggcaacagctgagccgtctgggaagggatgcatctatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaa

SEQ ID NO: 110860 - DNA, 492 bp, Homo sapiens
  Payload ID: 1747
  Gene Symbol: BBIP1
  Gene Name: BBSome interacting protein 1
  Uniprot ID: A8MTZ0
  ENST ID: ENST00000423273
  CDS Start-End: 94-297
ggggcaacagctgagccgtctgggaagggatgcatcttttcttctgtatgcttgagtcaagaactctaagtcatcttggtaataccgggttggatgcttaaagctgcagcaaaaagaccagaactttcagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaaca

SEQ ID NO: 110861 - DNA, 727 bp, Homo sapiens
  Payload ID: 1747
  Gene Symbol: BBIP1
  Gene Name: BBSome interacting protein 1
  Uniprot ID: A8MTZ0
  ENST ID: ENST00000447005
  CDS Start-End: 111-323
agggtgacgtagatttttttccttcgccagtctcaccgttacccggggcaacagctgagccgtctgggaagggatgcatctgaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattcca

SEQ ID NO: 110862 - DNA, 812 bp, Homo sapiens
  Payload ID: 1747
  Gene Symbol: BBIP1
  Gene Name: BBSome interacting protein 1
  Uniprot ID: A8MTZ0
  ENST ID: ENST00000454061
  CDS Start-End: 138-449
agggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcagggcttctcaaatttaataactatggaatcttatcagaaagtccattaacatctcaaagaacaacgtggttattgtatcaatcaccatcctttataccaggatttgcatatccttcaagatgcctgaagacaatcggaggggtatacaagcaagcgaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgttttt

SEQ ID NO: 110863 - DNA, 616 bp, Homo sapiens
  Payload ID: 1747
  Gene Symbol: BBIP1
  Gene Name: BBSome interacting protein 1
  ENST ID: ENST00000398289
  CDS Start-End: 119-256
tccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagagaagggatctcaatgtgttgcctaggctggtctcaaacccctgggctcaaacaaacaatccaacccctttggcatcccaaagtgctgggataacagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaa

SEQ ID NO: 110864 - DNA, 2119 bp, Homo sapiens
  Payload ID: 1747
  Gene Symbol: BBIP1
  Gene Name: BBSome interacting protein 1
  Uniprot ID: A8MTZ0
  ENST ID: ENST00000448814
  CDS Start-End: 211-489
tcggaagttactgttgaagctaaggcggccataactgataatggcaaaaggagattcctggcttcctgtttccagggtgacgtagatttttttccttcgccagtctcaccgttacccggggcaacagctgagccgtctgggaagggatgcatcttttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagattgatgaaatttgtattgtgaatgtaaacactctggtttgtattgaacataaacagttaaactatgaaccaagttttatggggtttaagtcatgtttttagaattgcaaattaaattatttgttcaccattcctattgctatcttttatagataacattcttgggatcttttatagcattcttgggcacaagggattaaatacaacttttatatacagaggatctttacatgtttattaaatctgaatttgaagatacattccaatcttgcataaagtgtttgttgggcttttacattacgtaattaaaaaacaaaattttttaaccaattttatgtgccatgtcacgtttaatgctatcttgtgtgaccagatcccaccagtaatgacaaaactgtcttaaacctcatttttttttttttttgagacaagagtttcactcttgttgcccaaacgagagcaatggcaccatctcgactcactgcaacctctgcctcccaggttcaagcaattctcctgcctcagcctcccaagtagctgggattacacgcatgcgccaccatgcctggctacttttgtatttttaatagagacagggtttcttcatgttggtcaagctggtcatgaactcccaacctcaagtgatccgcccacctcggcctcccaaagtgctgggattacaggcatgagccaccgtgcccagcccttaaatctcatttttaagaaaccctcacctattctgtagtcagctaagcttttaattacattaattttaagcacttgagaataaaatgactgcatttatcatccaagtgtcaaacaattaaaaacctaaaaatggtaactatatataagctgaggtaatatgggcttgataaagcccatgaggtaaatatgaacactaaacttggttttaattctaacagactatatctaaacctgtaagcagtatactcctaacagtaccctcataaattctgaatataattcttgtttgctgcagtcaatatttggcagtttaaattagcacagacgttgaggccttgctgagttattaggctatgtaaaagaggttaaaaatatgatcattctttattgttaattggtaatattttctcatacattaggtaaatgtcaagctttgggtctctggagtataactttttgtaacattagccattatttggtaacagaatttaaggatgatggaatgatggaaggtattacatatttctaaaacttaattaagctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccaataaagaatcaatactgcttca

SEQ ID NO: 110865 - DNA, 569 bp, Homo sapiens
  Payload ID: 1747
  Gene Symbol: BBIP1
  Gene Name: BBSome interacting protein 1
  Uniprot ID: A8MTZ0
  ENST ID: ENST00000605742
  CDS Start-End: 149-427
acttccgaattgggtcatggcggaagggtgttaatagcctggccgcccgtgccccagggaatgcttatttttgaccttagttgcaaagtgagtttcttctgtatgcttgagtcaagaactctaagtcatcttggtaataccgggttggatgcttaaagctgcagcaaaaagaccagaactttcaggaaaaaacactatatccaacaactcagatatggcagaagtgaagtcaatgttccgggaagttcttccaaagcaagggccactgtttgtggaagatataatgacaatggtgctgtgtaaacccaaacttttacccttaaaatctctgactctggaaaaactagagaaaatgcatcaagcagcacagaatacaattcgccaacaagaaatggcagaaaaggatcaacggcaaataacccactgaatgataactgagcactttagggaacaacctgccttatctactatttaacaataactagaaaatatgcttctgtgtgctgaaagtagtatgtgttatcaataaaattgatagtattcatagaaatacaaaaatatccaagatt

SEQ ID NO: 110866 - DNA, 1454 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000359273
  CDS Start-End: 138-1397
gaaaggacccggggcggggccgaacgcagcttccccaaggtgcaggcgcggtgaaaccatcgagacggagggccagagagtcacggcggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 110867 - DNA, 1583 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000392109
  CDS Start-End: 267-1526
aaaccatcgagacggagggccagagagtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 110868 - DNA, 1525 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000392110
  CDS Start-End: 210-1469
atcgagacggagggccagagagtcacggcggatcttattgtctacgatgtgacgatccgtggagaaagtagcagatgggcagattttcatttggggagaatgagggagaaaagaacgggcattccgagccaagagcactgcatgagcaaggagttgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 110869 - DNA, 1584 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000392111
  CDS Start-End: 268-1527
gtcacggcggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 110870 - DNA, 552 bp, Homo sapiens
  Payload ID: 1748
  Gene Symbol: BCS1L
  Gene Name: BC1 (ubiquinol-cytochrome c reductase) synthesis-like
  ENST ID: ENST00000436603
  CDS Start-End: 1-365
gcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 110871 - DNA, 804 bp, Homo sapiens
  Payload ID: 1748
  Gene Symbol: BCS1L
  Gene Name: BC1 (ubiquinol-cytochrome c reductase) synthesis-like
  ENST ID: ENST00000428880
  CDS Start-End: 575-804
aaggaggacgctgagccgtcaagattaagaaccttcacctgcgggagggcagggtgaggtaggagacaggtgggcaccagagaagaaatacgcttatcttccgggcaggagggctgaggaagagaaaggacagactaaggcagagagaaggcctggagaaacaacgggccccggcctagcgacccaggttcccacctgcctctggctctgactcaccgcgtggtcttggacagacacagtcgcttcgcttctctgggcctcagctttcctatctgtaaaatggaggtgatgacagtgtccacatcgtcgggcaggagctggatcataagagccagcgaactggaaaggcggtttgtaacctggaaggcttgggatggagcatcgtcatgattttgtcctgagagcagcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacct

SEQ ID NO: 110872 - DNA, 815 bp, Homo sapiens
  Payload ID: 1748
  Gene Symbol: BCS1L
  Gene Name: BC1 (ubiquinol-cytochrome c reductase) synthesis-like
  ENST ID: ENST00000456050
  CDS Start-End: 198-815
cccagagccggcgggagccgcatctctatggtcggccgcggctggaacggcccccggggcccgctttgtgcgaccgcctccggctcagccgcctctaggatattggggatgtggaagccactctctcttcctcttgccggctgccggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccag

SEQ ID NO: 110873 - DNA, 583 bp, Homo sapiens
  Payload ID: 1748
  Gene Symbol: BCS1L
  Gene Name: BC1 (ubiquinol-cytochrome c reductase) synthesis-like
  ENST ID: ENST00000423377
  CDS Start-End: 253-583
gagacggagggccagagagtcacggcggggtctgctgggagccagccattgaaggtgctggagcagagagagatatggtattggagctgatccctatgatgaaagatctggacccttgtgtagatgttccgtgaagcaggaggtgaagacctattaaaatgccatttcaagaactacgattttaaagacagtttaggtgggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcggggga

SEQ ID NO: 110874 - DNA, 1036 bp, Homo sapiens
  Payload ID: 1748
  Gene Symbol: BCS1L
  Gene Name: BC1 (ubiquinol-cytochrome c reductase) synthesis-like
  ENST ID: ENST00000430322
  CDS Start-End: 419-1036
cgggagggcagggtgaggtaggagacaggtgggcaccagagaagaaatacgcttatcttccgggcaggagggctgaggaagagaaaggacagactaaggcagagagaaggcctggagaaacaacgggccccggcctagcgacccaggttcccacctgcctctggctctgactcaccgcgtggtcttggacagacacagtcgcttcgcttctctgggcctcagctttcctatctgtaaaatggaggtgatgacagtgtccacatcgtcgggcaggagctggatcataagagccagcgaactggaaaggcggtttgtaacctggaaggcttgggatggagcatcgtcatgattttgtcctgagagcagcaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccag

SEQ ID NO: 110875 - DNA, 1483 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000439945
  CDS Start-End: 206-1465
acgggttaccccaaaccatgtggctggaggcgcgagctggggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctc

SEQ ID NO: 110876 - DNA, 1430 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000412366
  CDS Start-End: 114-1373
cacggcggtgagagggctgagtgacgggttaccccaaaccatgtggctggaggcgcgagctggggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacacta

SEQ ID NO: 110877 - DNA, 580 bp, Homo sapiens
  Payload ID: 1748
  Gene Symbol: BCS1L
  Gene Name: BC1 (ubiquinol-cytochrome c reductase) synthesis-like
  ENST ID: ENST00000443791
  CDS Start-End: 129-580
gaaaggacccggggcggggccgaacgcagcttccccaaggtgcaggcgcggtgaaaccatcgagacggagggccagagagtcacggcggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgag

SEQ ID NO: 110878 - DNA, 2015 bp, Homo sapiens
  Payload ID: 1748
  Gene Symbol: BCS1L
  Gene Name: BC1 (ubiquinol-cytochrome c reductase) synthesis-like
  Uniprot ID: Q9Y276
  ENST ID: ENST00000431802
  CDS Start-End: 700-1959
aaaccatgtggctggaggcgcgagctggggtgtgggcgaggttcaggagggggttcctgggtgtcgcggaggggccggggacgggagagctttgtctgtggccttccatgcataggtgttttggaattctggatcccagttctgaggctcagccgaggtcactgctgtcagctcacctccctgcatgccaggcgcagggcaaagtggccggggttcggggttggaggagaggtgtactagaaacaactttgctcttgtccctcaggatcttattgtctacgatgtgacgatccgtggagaaagtagcagatgggcagattttcatttggggagaatgagggagaaaagaacgggcattccgagccaagagcactgcatgagcaaggagttgggaggttgcttacttgttgaacatatttgttgcgtatttgcatatttgctaaacaggtagtgttaggagctaatccatgaaaggtaggtgggcgccgtattgtagagagccttgagtaccaggctgagtttatacccaattcaggggtctgctgggagccagccattgaaggtgctggagcagagagagatatggtattggagctgatccctatgatgaaagatctggacccttgtgtagatgttccgtgaagcaggaggttttcgtaacaccccagggcctgtaaggtttggtgtttccctttcaagatgccactttcagactttattctggctctgaaggacaatccctactttggggctggatttgggctggtgggtgtgggcacagccctggccctggcccggaagggtgtccaactgggcctggtggcattccggcgccattacatgatcacactggaagtccctgctcgagacaggagctatgcctggttgcttagctggctcacccgccacagtacccgtactcagcacctcagtgtcgagacttcgtaccttcagcatgagagtggccgcatttccactaagtttgaatttgtccccagccctggaaaccattttatctggtatcgggggaaatggattcgggtagaacgaagtcgagagatgcagatgatagacttgcagacggggactccttgggaatctgtcaccttcacggccctgggcactgaccgaaaggttttcttcaacatcctggaggaagctcgagagctagccttgcagcaggaggaagggaagaccgtgatgtacacagctgtgggctctgaatggcgtccctttggctatccacgccgccggcgaccactgaattctgtggttctacaacagggtctggctgaccgaattgtcagagacgtccaggaattcatcgataaccccaagtggtacactgacagaggcattccttacagacgtggctacctgctttatgggccccctggttgcggaaagagcagttttatcacagccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 110879 - DNA, 660 bp, Homo sapiens
  Payload ID: 1748
  Gene Symbol: BCS1L
  Gene Name: BC1 (ubiquinol-cytochrome c reductase) synthesis-like
  ENST ID: ENST00000426649
  CDS Start-End: 1-604
agaggcattccttacagacgtggctacctgctttatgggccccctggttgcggaaagagcagttttatccctggctggggaactggagcacagcatctgcctgctgagcctcacggactccagcctctctgatgaccgactcaaccacctgctgagcgtggccccgcagcagagcctggtactcctggaggatgtggatgctgcttttctcagtcgagacttggctgtggagaacccagtaaagtaccaaggcctaggtcgcctcaccttcagtggactgctcaatgccttggatggtgtggcttccaccgaggcccgcatcgtgttcatgaccaccaaccacgttgacaggctggaccctgccctgatacgcccggggcgagtggacctgaaggagtacgtgggctactgctcacactggcagctgacccagatgttccagaggttctatccagggcaggcaccttccttagctgagaactttgcagaacatgtccttcgagctacaaaccagatcagtcctgcccaggtgcagggctacttcatgctgtataaaaatgaccctgtaggggcaattcacaatgctgagtctctgaggaggtgatcaggctgggctcagctcagctctcctcctctagctcaataaacatctgccacact

SEQ ID NO: 110880 - DNA, 3253 bp, Homo sapiens
  Payload ID: 1749
  Gene Symbol: BCDIN3D
  Gene Name: BCDIN3 domain containing
  Uniprot ID: Q7Z5W3
  ENST ID: ENST00000333924
  CDS Start-End: 43-921
ggcttccggttccgccacggcccagaggctgtgttgaggctaatggcggtgcccacggaactggatggagggagtgttaaggagaccgcagcggaagaggaatcgcgagttctggcacctggcgccgccccgttcggaaattttcctcattattctcgcttccaccctccggagcaacggctccgcctcctgcccccggagctgcttcgacagctctttcctgagagtcccgagaacgggccgattctggggctcgacgtggggtgtaactccggggatctgagtgtggctctatacaaacacttcctctccctacctgacggggaaacctgctcagatgcctcaagagaattccgtctcctctgctgcgacatagatccagtcctggtgaagcgagccgaaaaagaatgtccttttcctgatgccttgacttttatcaccctggacttcatgaatcaaaggacccggaaggttctcttgagctctttcttaagccaatttggacgttcagtttttgacattggcttctgcatgtcaataaccatgtggattcatctgaatcatggagaccatggcctatgggagttcctggcccatctttcctccctctgccactacctccttgtggagccccaaccctggaagtgttaccgggcagctgcaaggcgtctccgaaagctgggactccatgattttgaccacttccactcccttgccatccgaggtgacatgcccaatcagattgtgcagatcttgacccaggatcatggcatggaattaatatgttgctttggcaacaccagttgggacagaagccttctgctcttcagggcaaaacaaaccatagagactcatccaatccctgaatcactgatagaaaaagggaaagaaaagaacagattaagtttccagaagcagtgagatgggagggcaagaagaccaagaaagatattgaaagggttttatattgagaattatgttcattctccttaattccttaacaatcaggcagccgcaaaacctggcaggagcttttggtaaaatgtccaaggcacataattgaaagaatcagtatctgttccccattgtttggaacaaatcttgaggagaatgaatctgtggagtgatgagctaggatatctggattgagatggcctaggaaaagtggtcctggttatgggttatggagagggctgcttttggggattatttataaagatcagactaggctagtcttaaaatatgtcagttcctgggctctctgaatcctacctggtttcttcaggcttctggacttgctaggcctgcctttgggcaaaaccttagtaattcaggtctggaatggggcttaggaatctattttctgtttttttgtttgtttgtttttgcattcttctattgtaatatatacataaaatttaccattttaaccgtttttaagtacagtttttcagaacgtggaaatcccatcaaaaattggattaaaaaattaaaagataaattgataatttttttaaaagtatacaattttgtgatattaagtacatttcacaatgaggcatctatttttaacagctcccccagatgattctgaggcaagcagaggtagaccatactttgagtgcttacggttccattcagtccttctctatgtatttttcctggggtgagttcttccctatggttttaacaactacctacatgcggccgggcgcggtggctcacgcctgtaatcgcagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaacaaaaaaaaaaacaactacctacatgcttatggtccccaaatatattggtagcccgacatccacagttccagactagcatttttcctgttttgtcattatatcccttagttcttaggtacatcagaatcaacagatctcaaaagcaagctcactaccctcattcaaaacctagtcctatctcatttgatagtaatcattgcttatgctagaaacctcagttgattttctcacttacactcccccacattgaaatgctctcaaagtccagcagcaaattctatcaattacatgtaagtttcattccatacatgtgtccggtgcctggtgggaggttcctatattaaagtcatctaccttccatccattgtctgccttacagccacagtttactcatctgtacaacgaaataacaccactttccttttcctatgcccaaatgagctaaggatgtgaaggtattttgcagaatatagagtgataaagaaaaataaggtgctattacactgtgtgagcatgccgcagaccacaactgcacttgttagactggaggcttatgagaaaaacatctcaccttgtagaaaacatgcatcttactatctctgataacttgtttttcaggatgatgaagtaataaggagtccagcttcagtgctacagagcattttaaaggaagcagtgttgggagggagggatatggaactaatggaaatgaggctagtttatgatggtctcagttatcacagtagatacagagctgagtttacccacaagatcttaatttaggaacactttgaaaccctgtaaccctgctgggtgctctctcctctcactccaccaaggcagcgcacagaaacatacatggggctgtggtaggatgaataatggtcccccaagatgtccacctcctttagcaaaaggggctttgcaaatgagattgaggatcttcagatagggagattaatctggatgatcagaatataccctaagtgcaatcatcagtgttcttataatagggaggcagagggagagctgaccacagtaggagatgtaatgacaaaagcaagaggttggagtgatatgaagaagggctgcaagtcaaggaatgcaggtggcttctagaagttagaaaaagcaagaaaatgtattctcccctgaagcctccagaaggaacagccctgccaacaccttgatttcagatttaatctccagagctgtaagagaataaatcagtattttaaaccactaa

SEQ ID NO: 110881 - DNA, 2456 bp, Homo sapiens
  Payload ID: 1750
  Gene Symbol: BLACE
  Gene Name: B-cell acute lymphoblastic leukemia expressed
  Uniprot ID: A4D250
  ENST ID: ENST00000378120
  CDS Start-End: 1262-1801
ggagcccctccgtccagcagccaccccgtctgggaagtgaggagcgtctccgcccggcagccaccccgtccgggggggaggtggggggggtcagccccccgcccggccagccgccccgtccgggagagatgggggtctcgccatgttgtccaggctggtgttgaactcctgagttcaagtgatcctcctgctttggctccccaaagtgctgggattacagggagcttcacaaatcatacattaaccagagctcctgaaacagaaggccagacgggacatattacagcaggaactggctcaccaccatccagggtcccgcatcccaggaggctgtttaaatcaacacacagactatgcaggtgtctttcccccagcgaacttcccagctcctcggtgggagggtctaacctgccctctccccagtgcgatatttcatgtcaccttctgggaactgcctggctgtggctcgacgcacggtgatggggacctcaccactgtcctgcccatgtgtcagaggaggagcagaggcacagagagacacccagagaagatagccatgcaacagcagaggggaggctggagccaaggacccccgggattgccggccacaccagaactgggccaggtgcagggcgatcctccctgcagacttcagagggggtgcccgcagtgcagagaccacaggggtccccgcgccgccggatgcccgaggatgtgagactgtgcaccatctgcccgctgcccgctgccacgtccgtgtgctcggggcagggaagagctcaagccagtgaccttgaaagagggaacacagctgagaaacgtgtcagatgcccttccgggctggcggcgctggctgcacatctgtctggagtgcgtggatgccagaagtcactgtccatggggtgacagcgcagcctggagctgatgagaggctgggtgcgcgctgcacgtctccagcaggtccccacagcaggctctgctgcaggcatctgggcggaactgagactggacagaccgaggctgccagcagagggaggggcaggaggcctgtcccagggaggcacagagggggtgcggcagggcctcccccagcctctccctcgcctggcacccccaccttccctcctttcctcgtgatcgccttcccttccctttcctttcttcttcccttcagaaggaggagctgtgggcagagggactttggaaagcatggcgttacttacctttcacacctctcagggcttacgccatcctcctgcgaatgatgaaagacatcatccctgcctccagctgggcctcggaagagagcactgatttacagaacgggagctttccccttagcgtggcccccaggtcagagtttcccagacggagggccttggaagattggcttctctcggtgtttctggcagaccaggcagaaagtgaggggcagctcgtgttggaaagagttcgggacacgccgccacccgtgacctctcctagaggtgacggcatatgtgtgagcagagggaaggctccgagcagccccggaggaagtacacatgcgtggctttatctaaccagacatttcccttggagtcctttcccccacggagggtggactgacacctcagaaccctgtgttctggagaccctggggggatcctccctggcagccctgcggggaaacagtctctgggtgcagagcagcggtgcctgtgctttttgtgtttatgagtcactcatcgagcagtctttgcccaatgaaaggtttgaggagctgttacttgggccaagtcctggggaagtgatgaaatagagacggtttgtcttcagtgctggcaacctcccctttttagtcacttctttcctgtctccagagagggtttcctctctggtcatccacttgctcaggcatcagtgttctgattctgcccaaactttcctctcttttaaattatccttcatggctaggatgggagtacttgtttatactaatgtgtaaatgactaaccagctaatattgcttatattctgtgtgggcaggaggctttgcataggcctctcacatgtcccgaggtttgcctttaggcagaggaccgtctcctctgacagcgttaacttaatgcacctgctacgcttaatgaatacttaggcttgatgaatacgcagatgcgccagatcagttctgggtaaaggacaaacaccgtgagcaggacaggtggggtctggagggggaggcagatgcaccaaggcaaggggaaatacctaaagactgttagtgtcagcacagcgtcgcttcaggccgagtaagcaatgcccatccagaaagtggcagatggtggcgtgtggagcaagacatggagagagaagatgaaagatgctcagatcggggctcggcaaactttctctacaaaggccagatgacaaataaaggaacggtggctgtgtgggccacccagggcctgcctgaa

SEQ ID NO: 110882 - DNA, 540 bp, Homo sapiens
  Payload ID: 1750
  Gene Symbol: BLACE
  Gene Name: B-cell acute lymphoblastic leukemia expressed
  Uniprot ID: A4D250
  ENST ID: ENST00000616210
  CDS Start-End: 1-540
atgatgaaagacatcatccctgcctccagctgggcctcggaagagagcactgatttacagaacgggagctttccccttagcgtggcccccaggtcagagtttcccagacggagggccttggaagattggcttctctcggtgtttctggcagaccaggcagaaagtgaggggcagctcgtgttggaaagagttcgggacacgccgccacccgtgacctctcctagaggtgacggcatatgtgtgagcagagggaaggctccgagcagccccggaggaagtacacatgcgtggctttatctaaccagacatttcccttggagtcctttcccccacggagggtggactgacacctcagaaccctgtgttctggagaccctggggggatcctccctggcagccctgcggggaaacagtctctgggtgcagagcagcggtgcctgtgctttttgtgtttatgagtcactcatcgagcagtctttgcccaatgaaaggtttgaggagctgttacttgggccaagtcctggggaagtgatgaaatag

SEQ ID NO: 110883 - DNA, 2819 bp, Homo sapiens
  Payload ID: 1751
  Gene Symbol: BCL10
  Gene Name: B-cell CLL/lymphoma 10
  Uniprot ID: O95999
  ENST ID: ENST00000370580
  CDS Start-End: 739-1440
tttttctttcaaaaatttgtttagtattgtagttaggctgtttgtgtgtatgcatgtgtatgtgtgtatgagtgcgtttgtgtgtgaccaaaacagtaactggcaaacgtaacaacaggaaattgtagggcagggtctgggaaaaggggaggaacccaaggtactgacaagcccagaccggactcccccgaagtgagcaggcagcaaaggctgagagtgccagctgcctgggcactgacggaccccacccacggaaacgatgccttatgaggaagctaacccgggccacttaccgacgacctgcgcaggcgtggcttgaggaaacgcccgctgtgggcggagccacccgaaaggctccggtcgggggcgggaacaggatcggcccgcgggctggcgtcgataggctgccgcagagacagggcgggctctgctaagcgacgcgcctcgccgtggggcggtgcctgcgcctgagcctctacgagagggaaggaacgctgctccgagctccgcgtcgcgtcgcgtagattcgcgtcgccgtcgacctcagaggcggggccggaagcgctacggtttgacccccgagtccctctgttcccgaaggggcggccgtctttctcccgacccgctccgcctcctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaaggactaaaatgtagcagttgtgaaccttttccagatggagccacgaacaacctctccagatcaaattcagatgagagtaatttctctgaaaaactgagggcatccactgtcatgtaccatccagaaggagaatccagcacgacgccctttttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacactttattgccttttaatttttaatgatgacaaaaaatgttttaaagaatatgactttttataaaatggctgtaatcatttgtttacatttgatgcatgtcttttaaaatgcaatgtaagcatactttgtaaataggatttttagaattaaaaaagcatacttctaggatagctaactgtaaatcatgttgatcatgtactttttagtaatttctttttttcctttttaaggtctttcagtacttttttaaatattttctattttaagactgattttaatagggaatatatctctatttgagaatagacccttactaggaagaacgttttttcctcagtgcatttgtgctagaaattttcaagagtctaatagtctttgccagtcattcagcagcaaattttcagcattaagctgttcctgttcagtaataaaaccggtcactgatgggaaaactgccaatatagaaaaataaaaatctcttttccactccattgtcgtataggcatgtaaacagcctctttttgatactggaggaacacttgatggagtgtgagccacctaagatctcggtttgccaaaattcatttctaattaaccttactaattatactactttgttaggattttcacattcttggcttaatcattttcattcctaaagaaaaatatcttggcctaaacctcagttattacatgtaatttgatgaggtattttttccttttttcttttttttttttttttttttttgagacagtcttgctctatcgcccaggctggagtgcagtggcgcattctaggctcactgcaacttctgcctcccatgcttacgtgatcctctcacctcagcctctcaagtaatatagctgagactacaagtgtgtgccaccatgcctcactaatttttgtattatttttgtagagacggtgttttgccatgttggccaggctggtcttgaactcctggactcaagcaacctacccagcgtggcctcccaaagtgctgggattacagacacgagccacctcacctagcctgatgagatttttaaaaaatattttctctgtacttttcattctcttttaatgaggaccaatgtacagttgaaataactggaacaaattatttttggtgtgtgtgacaattctgtttttaatgctatttgaacaagtgggccattagccagatttgtctttttgttgtaaaacaaaatttgactaattttacatgtttataaatcttatgctctcactgtttgtttttatttaaattacaattttatctgtttcctgacattgtctcctatatatttctattattaattgcaaaaacatagaaatggaaattttgctatcaacaataaaatttttttaaagta

SEQ ID NO: 110884 - DNA, 774 bp, Homo sapiens
  Payload ID: 1751
  Gene Symbol: BCL10
  Gene Name: B-cell CLL/lymphoma 10
  ENST ID: ENST00000620248
  CDS Start-End: 105-575
ctctccttcttccccattacccggaggccgaagcccccagccagggcggggcggcgcagcccgagctcccggacccggaagaagcgccatctcccgcctccaccatggagcccaccgcaccgtccctcaccgaggaggacctcactgaagtgaagaaggacgccttagaaaatttacgtgtatacctgtgtgagaaaatcatagctgagagacattttgatcatctacgtgcaaaaaaaatactcagtagagaagacactgaagaaatttcttgtcgaacatcaagtagaaaaagggctggaaaattgttagactacttacaggaaaacccaaaaggtctggacacccttgttgaatctattcggcgagaaaaaacacagaacttcctgatacagaagattacagatgaagtgctgaaacttagaaatataaaactagaacatctgaaagatggagccacgaacaacctctccagatcaaattcagatgagagtaatttctctgaaaaactgagggcatccactgtcatgtaccatccagaaggagaatccagcacgacgccctttttctactaattcttctctgaatttgcctgttctagaagtaggcagaactgaaaataccatcttctcttcaactacacttcccagacctggggacccaggggctcctcctttgccaccagatctacagttagaagaagaaggaacttgtgcaaactctagtgagatgtttcttcccttaagatcacgtactgtttcacgacaatgacac

SEQ ID NO: 110885 - DNA, 5942 bp, Homo sapiens
  Payload ID: 1752
  Gene Symbol: BCL11A
  Gene Name: B-cell CLL/lymphoma 11A (zinc finger protein)
  Uniprot ID: Q9H165
  ENST ID: ENST00000335712
  CDS Start-End: 229-2736
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaacaaacaaacagaagtaacgaagctaagaatatgagagtgcttgtcaccagcacacctgttttttttctttttctttttcttttttctttttccttttttttttttttcctttatgttctcaccgtttgaatgcatgatctgtatggggcaatactattgcattttacgcaaactttgagcctttctcttgtgcaataatttacatgttgtgtatgtttttttttaaacttagacagcatgtatggtatgttatggctattttaaattgtccctaattcgttgctgagcaaacatgttgctgtttccagttccgttctgagagaaaaagagagagagagagaaaaagaccatgctgcatacattctgtaatacatatcatgtacagttttattttataacgtgaggaggaaaaacagtctttggattaaccctctatagacagaatagatagcactgaaaaaaaatctctatgagctaaatgtctgtctctaaagggttaaatgtatcaattggaaaggaagaaaaaaggccttgaattgacaaattaacagaaaaacagaacaagtttattctatcatttggttttaaaatatgagtgccttggatctattaaaaccacatcgatggttctttctacttgttataaacttgtagcttaattcagcattgggtgaggtaataaaccttaggaactagcatataattctatattgtatttctcacaacaatggctacctaaaaagatgacccattatgtcctagttaatcatcatttttcctttagtttaattttataaacaaaactgattataccagtataaaagctactttgctcctggtgagagcttaaaagaaatgggctgttttgcccaaagttttattttttttaaacaatgattaaattgaatgtgtaatgtgcaaaagccctggaacgcaattaaatacactagtaaggagttcattttatgaagatatttgctttaataatgtctttttaaaaatactggcaccaaaagaaatagatccagatctacttggttgtcaagtggacaatcaaatgataaactttaagaccttgtataccatattgaaaggaagaggctgacaataaggtttgacagaggggaacagaagaaaataatatgatttattagcacaacgtggtactatttgccatttaaaactagaacaggtatataagctaatattgatacaatgatgattaactatgaattcttaagacttgcatttaaatgtgacattcttaaaaaaagaagagaaagaattttaagagtagcagtatatatgtctgtgctccctaaaagttgtacttcatttcttttccatacactgtgtgctatttgtgttaacatggaagaggattcattgtttttatttttatttttttaattttttcttttttattaagctagcatctgccccagttggtgttcaaatagcacttgactctgcctgtgatatctgtatcttttctctaatcagagatacagaggttgagtataaaataaacctgctcagataggacaattaagtgcactgtacaattttcccagtttacaggtctatacttaagggaaaagttgcaagaatgctgaaaaaaaattgaacacaatctcattgaggagcattttttaaaaactaaaaaaaaaaaaactttgccagccatttacttgactattgagcttacttacttggacgcaacattgcaagcgctgtgaatggaaacagaatacacttaacatagaaatgaatgattgctttcgcttctacagtgcaaggatttttttgtacaaaacttttttaaatataaatgttaagaaaaattttttttaaaaaacacttcattatgtttaggggggaactgcattttagggttccattgtcttggtggtgttacaagacttgttatccatttaaaaatggtagtggaaattctatgccttggatacacaccgctcttcaggttgtaaaaaaaaaaaacatacattggggaaaggtttaagattatatagtacttaaatataggaaaatgcacactcatgttgattcctatgctaaaatacatttatggtcttttttctgtatttctagaatggtatttgaattaaatgttcatctagtgttaggcactatagtatttatattgaagcttgtatttttaactgttgcttgttctcttaaaaggtatcaatgtaccttttttggtagtggaaaaaaaaaagacaggctgccacagtatatttttttaatttggcaggataatatagtgcaaattatttgtatgcttcaaaaaaaaaaaaaagagagaaacaaaaaagtgtgacattacagatgagaagccatataatggcggtttgggggagcctgctagaatgtcacatggatggctgtcataggggttgtacatatccttttttgttcctttttcctgctgccatactgtatgcagtactgcaagctaataacgttggtttgttatgtagtgtgctttttgtccctttccttctatcaccctacattccagcatcttaccttcatatgcagtaaaagaaagaaagaaaaaaaaaggaaaaaaaaaaaaaaaccaatgttttgcagtttttttcattgccaaaaactaaatggtgctttatatttagattggaaagaatttcatatgcaaagcatattaaagagaaagcccgctttagtcaatacttttttgtaaatggcaatgcagaatattttgttattggccttttctattcctgtaatgaaagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcatacacccattttgtccctttattgaaaaaataaaaaaaattaaag

SEQ ID NO: 110886 - DNA, 3959 bp, Homo sapiens
  Payload ID: 1752
  Gene Symbol: BCL11A
  Gene Name: B-cell CLL/lymphoma 11A (zinc finger protein)
  Uniprot ID: Q9H165
  ENST ID: ENST00000356842
  CDS Start-End: 230-2551
tttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 110887 - DNA, 2697 bp, Homo sapiens
  Payload ID: 1752
  Gene Symbol: BCL11A
  Gene Name: B-cell CLL/lymphoma 11A (zinc finger protein)
  Uniprot ID: Q9H165
  ENST ID: ENST00000358510
  CDS Start-End: 162-2567
tctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgtgagtactgtgggaaagtcttcaagaactgtagcaatctcactgtccacaggagaagccacacgggcgaaaggccttataaatgcgagctgtgcaactatgcctgtgcccagagtagcaagctcaccaggcacatgaaaacgcatggccaggtggggaaggacgtttacaaatgtgaaatttgtaagatgccttttagcgtgtacagtaccctggagaaacacatgaaaaaatggcacagtgatcgagtgttgaataatgatataaaaactgaatagaggtatattaatacccctccctcactcccacctgacaccccctttttcaccactccccttccccatcgccctccagccccactccctgtaggatttttttctagtcccatgtgatttaaacaaacaaaca

SEQ ID NO: 110888 - DNA, 2427 bp, Homo sapiens
  Payload ID: 1752
  Gene Symbol: BCL11A
  Gene Name: B-cell CLL/lymphoma 11A (zinc finger protein)
  Uniprot ID: Q9H165
  ENST ID: ENST00000359629
  CDS Start-End: 298-1029
tttttttcatctctctctctctctctccctctatctctcttctctctctctccctctttttttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 110889 - DNA, 756 bp, Homo sapiens
  Payload ID: 1752
  Gene Symbol: BCL11A
  Gene Name: B-cell CLL/lymphoma 11A (zinc finger protein)
  ENST ID: ENST00000409351
  CDS Start-End: 231-659
ttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagctcagactgaactggaggatgtatttgtgtaccttatggtgtaattgtaaatgagactataaattatagtatgctattatgactacttatttttcttttctctttatttatgtgattctgaataaaaacgactgacttctg

SEQ ID NO: 110890 - DNA, 1508 bp, Homo sapiens
  Payload ID: 1752
  Gene Symbol: BCL11A
  Gene Name: B-cell CLL/lymphoma 11A (zinc finger protein)
  ENST ID: ENST00000489516
  CDS Start-End: 149-724
gcggatcagacgcggcgcgcggcggtgtgaagttacagcccggccagccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctacc

SEQ ID NO: 110891 - DNA, 567 bp, Homo sapiens
  Payload ID: 1752
  Gene Symbol: BCL11A
  Gene Name: B-cell CLL/lymphoma 11A (zinc finger protein)
  ENST ID: ENST00000479026
  CDS Start-End: 1-52
gaaaaaatggcacagtgatcgagtgttgaataatgatataaaaactgaatagaggttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtg

SEQ ID NO: 110892 - DNA, 2316 bp, Homo sapiens
  Payload ID: 1752
  Gene Symbol: BCL11A
  Gene Name: B-cell CLL/lymphoma 11A (zinc finger protein)
  ENST ID: ENST00000631857
  CDS Start-End: 238-741
tttttttttttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaacccaagggggagctcagagaagagtccaggctgccagtgcaaaggtccagccctgtcgccaaggagaccctcagggaaatgcacaggcctccagctattcccacggcccctgtagctgagcgccagcttcttcctgggccaagctgaggctgtttcctgccgtgtccattctcctagcaacgcttctctttggccagtttgccatagtacctgagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcggagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgcta

SEQ ID NO: 110893 - DNA, 7603 bp, Homo sapiens
  Payload ID: 1753
  Gene Symbol: BCL11B
  Gene Name: B-cell CLL/lymphoma 11B (zinc finger protein)
  Uniprot ID: Q9C0K0
  ENST ID: ENST00000345514
  CDS Start-End: 268-2739
ttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 110894 - DNA, 7559 bp, Homo sapiens
  Payload ID: 1753
  Gene Symbol: BCL11B
  Gene Name: B-cell CLL/lymphoma 11B (zinc finger protein)
  Uniprot ID: Q9C0K0
  ENST ID: ENST00000357195
  CDS Start-End: 11-2695
tgccggggcaatgtcccgccgcaaacagggcaacccgcagcacttgtcccagagggagctcatcaccccagaggctgaccatgtggaggccgccatcctcgaagaagacgagggtctggagatagaggagccaagtggcctggggctgatggtgggtggccccgaccctgacctgctcacctgtggccagtgtcaaatgaacttccccttgggggacatcctggtttttatagagcacaaaaggaagcagtgtggcggcagcttgggtgcctgctatgacaaggccctggacaaggacagcccgccaccctcctcacgctccgagctcaggaaagtgtccgagccggtggagatcgggatccaagtcacccccgacgaagatgaccacctgctctcacccacgaaaggcatctgtcccaagcaggagaacattgcagggccgtgcaggcctgcccagctgccagcggtggcccccatagctgcctcctcccaccctcactcatccgtgatcacttcacctctgcgtgccctgggcgctctcccgccctgcctccccctgccgtgctgcagcgcgcgcccggtctcgggtgacgggactcagggtgagggtcagacggaggctccctttggatgccagtgtcagttgtcaggtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagtacaaattgtggagccttttaactgtgcaataatttctgtatttattgggttttgtaatttttttggcatgtgcaggtactttttattattattttttctgtttgaattcctttaagagattttgttgggtatccatcccttctttgttttttttttaacccggtagtagcctgagcaatgactcgcaagcaatgttagaggggaagcatatcttttaaattataatttggggggaggggtggtgctgcttttttgaaatttaagctaagcatgtgtaatttcttgtgaagaagccaacactcaaatgacttttaaagttgtttactttttcattccttccttttttttgtcctgaaataaaaagtggcatgcagttttttttttaattattttttaattttttttttggtttttgtttttggggtggggggtgtggatgtacagcggataacaatctttcaagtcgtagcactttgtttcagaactggaatggagatgtagcactcatgtcgtcccgagtcaagcggccttttctgtgttgatttcggctttcatattacataagggaaaccttgagtggtggtgctgggggaggcaccccacagactcagcgccgccagagatagggtttttggagggctcctctgggaaatggcccgacagcattctgaggttgtgcatgaccagcagatactatcctgttggtgtgccctggggtgccatggctgctattcgctgtagattaggctacataaaatgggctgagggtacctttttggggagatggggtggcctgcagtgacacagaaaggaagaaactagcggtgttcttttaggcgttttctggcttgacggcttctctctttttttaaatcacccccaccacataaatctcaaatcctatgttgctacaaggggtcatccatcatttcccaagcagacgaatgccctaattaattgaagttagtgttctctcatttaatgcacactgatgatattgtagggatgggtggggtggggatcttgcaaatttctattctcttttactgaaaaagcaggggatgagttccatcagaaggtgcccagcgctacttcccaggtttttattttttttttcctatctcattaggttggaaggtactaaatattgaactgttaagattagacatttgaattctgttgacccgcactttaaagcttttgtttgcatttaaattaaatggcttctaaacaagaaattgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagacaaatgcaaaactttttttttgaaatgaaaagactttttaaaaaagtaaaacaagaaaagtacattctttagaaactaacaaagccacatttactttaagtaaaaaaaaaaaaaattctggttgaagatagaggatatgaaatgccataagacccaatcaaatgaagaaataaacccagcacaaccttggacatccattagctgaattatcctcagccccttttgtttttgggacaacgctgcttagatatggagtggaggtgatttactgctgaattaaaactcaagtgacacaagttacaagttgatatcgttgaatgaaaagcaaaacaaaaacaattcaggaacaacggctaattttttctaaagttaaatttagtgcactctgtcttaaaaatacgtttacagtattgggtacatacaagggtaaaaaaaaaattgtgtgtatgtgtgttggagcgatctttttttttcaaagtttgcttaataggttatacaaaaatgccacagtggccgcgtgtatattgttttcttttggtgacggggttttagtatatattatatatattaaaatttcttgattactgtaaaagtggaccagtatttgtaataatcgagaatgcctgggcattttacaaaacaagaaaaaaaatacccttttcttttccttgaaaatgttgcagtaaaatttaaatggtgggtctataaatttgttcttgttacagtaactgtaaagtcggagttttagtaaatttttttctgccttgggtgttgaatttttatttcaaaaaaaatgtatagaaacttgtatttggggattcaaaggggattgctacaccatgtagaaaaagtatgtagaaaaaaagtgcttaatattgttattgctttgcagaaaaaaaaaaaatcacatttctgacctgtacttatttttctcttcccgcctccctctggaatggatatattggttggttcatatgatgtaggcacttgctgtatttttactggagctcgtaattttttaactgtaagcttgtccttttaaagggatttaatgtacctttttgttagtgaatttggaaataaaaagaaaaaaaaaacaaaaacaaacaggctgccataatatatttttttaatttggcaggataaaatattgcaaaaaaaacacatttgtatgttaagtcctattgtacaggagaaaaagggttgtttgacaacctttgagaaaaagaaacaaaaggaagtagttaaatgctttggttcacaaatcatttagttgtatatattttttgtcggaattggcctacacagagaaccgttcgtgttgggcttctctctgaacgccccgaaccttgcatcaaggctccttggtgtggccacagcagaccagatgggaaattatttgtgttgagtggaaaaaaatcagtttttgtaaagatgtcagtaacattccacatcgtcctccctttctctaagaggccatctctaagatgtcagatgtagaggagagagagcgagagaacatcttccttctctaccatcactcctgtggcggtcaccaccaccacctctcccgcccttaccagcagaaagcaatgcaaactgagctgctttagtccttgagaaattgtgaaacaaacacaaatatcataaaaggagctggtgattcagctgggtccaggtgaagtgacctgctgttgagaccggtacaaattggatttcaggaaggagactccatcacagccaggacctttcgtgccatggagagtgttggcctcttgtctttcttccctgctttgctgctttgctctctgaaacctacattccgtcagtttccgaatgcgagggcctgggatgaatttggtgcctttccatatctcgttctctctccttcccctgcgtttcctctccatccttcatcctccattggtcctttttttttctttcattttttatttaatttcttttcttcctgtctgttcctcccctaatcctctattttatttttattttttgtaaagccaagtagctttaagataaagtggtggtcttttggatgagggaataatgcatttttaaataaaataccaatatcaggaagccattttttatttcaggaaatgtaagaaaccattatttcaggttatgaaagtataaccaagcatccttttgggcaattccttaccaaatgcagaagcttttctgttcgatgcactctttcctccttgccacttacctttgcaaagttaaaaaaaaggggggagggaatgggagagaaagctgagatttcagtttcctactgcagtttcctacctgcagatccaggggctgctgttgcctttggatgccccactgaggtcctagagtgcctccagggtggtcttcctgtagtcataacagctagccagtgctcaccagcttaccagattgccaggactaagccatcccaaagcacaagcattgtgtgtctctgtgactgcagagaagagagaattttgcttctgttttgtgtttaaaaaaccaacacggaagcagatgatcccgagagagaggcctctagcatgggtgacccagccgacctcaggccggtttccgcactgccacaactttgttcaaagttgcccccaattggaacctgccacttggcattagagggtctttcatggggagagaaggagactgaattactctaagcaaaatgtgaaaagtaaggaaatcagcctttcatcccggtcctaagtaaccgtcagccgaaggtctcgtggaacacaggcaaacccgtgattttggtgctccttgtaactcagccctgcaaagcaaagtcccattgatttaagttgtttgcatttgtactggcaaggcaaaatatttttattaccttttctattacttattgtatgagcttttgttgtttacttggaggttttgtcttttactacaagtttggaactatttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctccaaa

SEQ ID NO: 110895 - DNA, 2599 bp, Homo sapiens
  Payload ID: 1753
  Gene Symbol: BCL11B
  Gene Name: B-cell CLL/lymphoma 11B (zinc finger protein)
  ENST ID: ENST00000443726
  CDS Start-End: 307-2409
tttttttttgcctctttttcttattttagatcgagaggtttttcttgcttttcttcccttttttttctttttgcaaacaaaacaaaaaacagcatagaagaaagagcaaaataaagaagaagaagaggaggaagagagggaaagagaggaagggaaaaaaaacaccaacccgggcagaggaggaggtgcggcggcggcggcggcggcggcagcggcggcagcggcgcggcggcggctcggaccccctcccccggctccccccatcagtgcagctctccgggcgatgccagaatagatgccggggcaatgtcccgccgcaaacagggcaacccgcagcacttgtcccagagggagctcatcacccgtaaagatgagccttccagctacatttgcacaacatgcaagcagcccttcaacagcgcgtggttcctgctgcagcacgcgcagaacacgcacggcttccgcatctacctggagcccgggccggccagcagctcgctcacgccgcggctcaccatcccgccgccgctcgggccggaggccgtggcgcagtccccgctcatgaatttcctgggcgacagcaaccccttcaacctgctgcgcatgacgggccccatcctgcgggaccacccgggcttcggcgagggccgcctgccgggcacgccgcctctcttcagtcccccgccgcgccaccacctggacccgcaccgcctcagtgccgaggagatggggctcgtcgcccagcaccccagtgccttcgaccgagtcatgcgcctgaaccccatggccatcgactcgcccgccatggacttctcgcggcggctccgcgagctggcgggcaacagctccacgccgccgcccgtgtccccgggccgcggcaaccctatgcaccggctcctgaaccccttccagcccagccccaagtccccgttcctgagcacgccgccgctgccgcccatgccccctggcggcacgccgcccccgcagccgccagccaagagcaagtcgtgcgagttctgcggcaagaccttcaagttccagagcaatctcatcgtgcaccggcgcagtcacacgggcgagaagccctacaagtgccagctgtgcgaccacgcgtgctcgcaggccagcaagctcaagcgccacatgaagacgcacatgcacaaggccggctcgctggccggccgctccgacgacgggctctcggccgccagctcccccgagcccggcaccagcgagctggcgggcgagggcctcaaggcggccgacggtgacttccgccaccacgagagcgacccgtcgctgggccacgagccggaggaggaggacgaggaggaggaggaggaggaggaggagctgctactggagaacgagagccggcccgagtcgagcttcagcatggactcggagctgagccgcaaccgcgagaacggcggtggtggggtgcccggggtcccgggcgcggggggcggcgcggccaaggcgctggctgacgagaaggcgctggtgctgggcaaggtcatggagaacgtgggcctaggcgcactgccgcagtacggcgagctcctggccgacaagcagaagcgcggcgccttcctgaagcgtgcggcgggcggcggggacgcgggcgacgacgacgacgcgggcggctgcggggacgcgggcgcgggcggcgcggtcaacgggcgcgggggcggcttcgcgccaggcaccgagcccttccccgggctcttcccgcgcaagcccgcgccgctgcccagccccgggctcaacagcgccgccaagcgcatcaaggtggagaaggacctggagctgccgcccgccgcgctcatcccgtccgagaacgtgtactcgcagtggctggtgggctacgcggcgtcgcggcacttcatgaaggaccccttcctgggcttcacggacgcacgacagtcgcccttcgccacgtcgtccgagcactcgtccgagaacggcagcctgcgcttctccacgccgcccggggacctgctggacggcggcctctcgggccgcagcggcacggccagcggaggcagcaccccgcacctgggcggcccgggccccgggcggcccagctccaaggagggccgccgcagcgacacgtgcgagtactgcggcaaggtgttcaagaactgcagcaacttgacggtgcaccggcggagccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggcgagcacttgctgactaacgacgtcaaaatcgagcaggccgagaggagctaagcgcgcgggccccggcgccccgcacctgtacagtggaaccgttgccaaccgagagaatgctgacctgacttgcctccgtgtcaccgccaccccgcaccccgcgtgtccccggggcccaggggaggcggcactccaacctaacctgtgtctgcgaagtcctatggaaacccgagggttgattaaggcagta

SEQ ID NO: 110896 - DNA, 3209 bp, Homo sapiens
  Payload ID: 1754
  Gene Symbol: BCL2
  Gene Name: B-cell CLL/lymphoma 2
  Uniprot ID: P10415
  ENST ID: ENST00000333681
  CDS Start-End: 900-1619
accacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaacatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaa

SEQ ID NO: 110897 - DNA, 7461 bp, Homo sapiens
  Payload ID: 1754
  Gene Symbol: BCL2
  Gene Name: B-cell CLL/lymphoma 2
  Uniprot ID: P10415
  ENST ID: ENST00000398117
  CDS Start-End: 1463-2182
gcgcccgcccctccgcgccgcctgcccgcccgcccgccgcgctcccgcccgccgctctccgtggccccgccgcgctgccgccgccgccgctgccagcgaaggtgccggggctccgggccctccctgccggcggccgtcagcgctcggagcgggctgcgcggcgggagctccgggaggcggccgtagccagcgccgccgcgcaggaccaggaggaggagaaagggtgcgcagcccggaggcggggtgcgccggtggggtgcagcggaagagggggtccaggggggagaacttcgtagcagtcatcctttttaggaaaagagggaaaaaataaaaccctcccccaccacctccttctccccacccctcgccgcaccacacacagcgcgggcttctagcgctcggcaccggcgggccaggcgcgtcctgccttcatttatccagcagcttttcggaaaatgcatttgctgttcggagtttaatcagaagaggattcctgcctccgtccccggctccttcatcgtcccctctcccctgtctctctcctggggaggcgtgaagcggtcccgtggatagagattcatgcctgtgcccgcgcgtgtgtgcgcgcgtgtaaattgccgagaaggggaaaacatcacaggacttctgcgaataccggactgaaaattgtaattcatctgccgccgccgctgccttttttttttctcgagctcttgagatctccggttgggattcctgcggattgacatttctgtgaagcagaagtctgggaatcgatctggaaatcctcctaatttttactccctctccccgcgactcctgattcattgggaagtttcaaatcagctataactggagagtgctgaagattgatgggatcgttgccttatgcatttgttttggttttacaaaaaggaaacttgacagaggatcatgctgtacttaaaaaatacaagtaagttctctgcacaggaaattggtttaatgtaactttcaatggaaacctttgagattttttacttaaagtgcattcgagtaaatttaatttccaggcagcttaatacattctttttagccgtgttacttgtagtgtgtatgccctgctttcactcagtgtgtacagggaaacgcacctgattttttacttattagtttgttttttctttaacctttcagcatcacagaggaagtagactgatattaacaatacttactaataataacgtgcctcatgaaataaagatccgaaaggaattggaataaaaatttcctgcatctcatgccaagggggaaacaccagaatcaagtgttccgcgtgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgtaccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgtttttaatataaagcctgttttgtcttttgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaattaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaagaatttttaaatgtaaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 110898 - DNA, 5011 bp, Homo sapiens
  Payload ID: 1754
  Gene Symbol: BCL2
  Gene Name: B-cell CLL/lymphoma 2
  Uniprot ID: P10415
  ENST ID: ENST00000589955
  CDS Start-End: 147-764
tgattgaagacaccccctcgtccaagaatgcaaagcacatccaataaaatagctggattataactcctcttctttctctgggggccgtggggtgggagctggggcgagaggtgccgttggcccccgttgcttttcctctgggaaggatggcgcacgctgggagaacagggtacgataaccgggagatagtgatgaagtacatccattataagctgtcgcagaggggctacgagtgggatgcgggagatgtgggcgccgcgcccccgggggccgcccccgcaccgggcatcttctcctcccagcccgggcacacgccccatccagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccagccagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggtaggtgcacttggtgatgtgagtctgggctgaggccacaggtccgagatgcgggggttggagtgcgggtgggctcctggggcaatgggaggctgtggagccggcgaaataaaatcagagttgttgcttcccggcgtccctacctcctcctctggacaaagcgttcactcccaacctgaccgataacgcctgccatctaaaagtctttaacttgcttgctagtcgtggagatccaaagatctagcgtttgtaatccagtaggatgtggtggtaaatggtaccccttcagtgtttctcaagctgaaggtccaggagtccccaggaccaccgtttcctggcttgagcagcttgttggaaccggagggaggtttcagggactgcttatgaaccagataccaggttgggtcttgacagtctgcatcccaaacaagctcccctgaaacaagcccgttgtacactaaaattggagaacaacccgattagaagaatagactccacagaagaccaagggcatcatcaatcggtaaaattttccaaaagaggaaaaccaatgtaagtctttttccctgaaaaacttagttgtgtttgtaaagagctaagttgacattccaaagtccttggactggaatctccagtgtgtgccatgttcccagtgggcgtgatgaggtgtcctgaggagtatcaggctatggctttgctaccttgtcagtgacagaatttgcatcggctgcattctttgtattctataatttgtgtatggtttaccagtttgctagaatgttagaatcttttgtttttcaccactcagagtggacctaattttgtggtcggctgaaaaaaatttgcatctaggtatctatgtaaagtgtagaagaattgattcttagctgtggattatcttacccttactttagttgaagtgattgatacctgtggctttgaagaacatttgtgagatgatctttttctcgtactgtgctagatagagctttcatcattataccatacaattgtacttttctgagattctttgttggagggggtttagttcctaagagtcaaggattgtaatggagatctatatctcatatctaaaatgatgaatttatgaaaaagtaattcttgtgtgaagttttttttttttttacactttttgttttaatctgaagagttatctttgaaaaacaggatgcaattcagtgcttccttttatagcctcttgggagaatgactaatgtcattattttataggacctaacaggagcaaaaagcctagaaattactgcaagtggattagatgtcaagaagcacaccacatgtttttattacattttacaaagtgtgctcatactaggaggccaaatagagaaaaggccaagaaaagtagatgattgatgtgaacatctgatcttatttgaccaaagttgacaaaatattgatgccactgtttggtgtttaaaagtaagattaactaaaatgccccaatttaaatttctaaaatttaaatcctcttcttgaattgtttgtttgttgagatctcacattatcagatctttagtaattctggaagaatttgctaaagggtgaaaagaatatttttgttaaatatttggttaagtaggtggtttgatttttaatcactataactaaaggggttgggacttccagattcccaaaggatccttttaaaccaaagtaaaactgatttaatagttttactatttcacatttttgtgaaaaattcacacttacaaattttctttctacttgaaataaatccaaggtggtaactggtatctgtctatcaaataagttaataaaaatgtgggaaacagagacacatgtttatgacagaaattaagatacaaccttgatatttgttgctgaatttcagtgtgttaccctctcatgtaactgaagtttctttttaagtaaaggctcacttttttctttttgtgaaacagagttttcatagtagacctatctttgtggtcaacaggtatctgaggttgataaatgtagaggctacattttatgatgccaaaccacaatgacataccatagaacatgataaaaattttttgacaaaactgcttctagtaaaaataaatcatgtagaagcacagatggttgatggtaaaatatgtaatagctttcagaacaatgcatagatggtgactatataggaaaacaaaggaatttagagaaaaaatatatatatataccaggaaatgcactcataggacactttggaataaaagtggtagtgtttgagaatgatgaatgatttgcctatcatttcaaatgtgcattattaatctaaaagtcattttaggcatttggcatacagacagattttcttcacatttacaccaattggggttacatctctaataatatgttgtattttatagtgtaaggtagtcttaatggtaaagcttcagaagagagctagcatattttcttggcatgtgacaataatctgcactgtccccagggctccgtggattagcccatctcctgaatactacactgaatactccaggctttagactgcaagtcatttctttttctttgctgctgctcgtagaaaattggaaccttgtgaggctgaggaaatctgtttgacttttgtgttccataacatggataaatcaggtccttggaatgatcagcctctgatagattgtcccagaagactacaaattaaataaagactaaagaagtaattggctgtagagtggagtgtggatttattcctaggtctgaataaggcattgtgtggcatccagagagaggcaggacagaggaagcagtgagagagaagcaattctagaaaatgtggataccttgctgctcagtgtggcttatagacagtagcacatgcatcccccggagctttgtagagatgctaaagctcagctcccaccccagagctactgagtcagaatatgtggtttgtgtgcacgttaaagttagcgatgctggctaccatccttggttcctggtggcatcttttaggaagagttgctacctgggatggattctgcattgtccccttccagtggccttaaagatctatagtgttacttggaataccgagtatttcccaggtgtccactattgtgatctgactttaggaagacataaattggatgaaggagagatagcaagcaggtagatcaactataagcccagtcttctcatgaatatttttcgtagtagttatatagtttatattggcatcactggtcccattaaaaagtaagatagcttttcttcaattaaaggcaagagaattagctcttttaatagctctgttagttattattttatcccctcataacacagtttaaattctgtaaatgactttagtgaccttgcagcttctttaagacaaagggactcttgcaggcaagggattgagttttgggcaggtgatggagagtgaccctctaaactgggaactgtgacgacattcagcttcatgtcttaggagagagtgagataggagccactagaagaatgagatgattcagacaagagattgtaggagattggctttattctgttgacaagatggtaatccgacttattttttggttttttggtgttggtggtttaggaagacaggaacttctccacacccggtagagttcagctgccttttcattagtcagcaagcagtttttcctttctcaaggcagtccacatccagcaaaacatttgattaactggaaagcaataccattctcatgccagtgtacaaattacatgaaagagcatcatttttctagtgtctgaggattggctgcttatggccaattttggcagcaagacgataggattaaaaatagcttgaagatgatctagtcttaaataatatatttcatgatgaactttccttgggaaagtgcatctttctgcctacaagaatcacatgacccctttcaataatttatgtagtagagaaaaacacactatttctcatagagttttcagtcatgtgctgtggtgtgattgtttctggacattcataaaattttatagttaactgaattctcttttctgttttgttgctatttaacgtccattgaaaacatggctttcttttgcgcattctgttactttcagctgtactttctaataagaatggattgccctttttagcaatctttgattgaactggtacatttcagattacttaaatgtcatcaggccacacagcataccaggtaacagaaagccataaattaaaaataaaaaaaaggcaagcaaaa

SEQ ID NO: 110899 - DNA, 2038 bp, Homo sapiens
  Payload ID: 1755
  Gene Symbol: BCL3
  Gene Name: B-cell CLL/lymphoma 3
  Uniprot ID: P20749
  ENST ID: ENST00000164227
  CDS Start-End: 245-1609
cgggcggggcgcagggcaggctgcacctcagagcggcgggagcagcggcgggtccaggaaacccctggggcgtacgggtggccccgggggggccgggggcggggaggcgggcggccggcaccgccccggccgacaaaagtcccttcagttcagccggctgcaggggaagtcccggcgcccggcgaaaccaccctcccgtgcagccgagcccagccgctctccggccgccgtccccggcggccccatgccccgatgccccgcgggggccatggacgaggggcccgtggacctgcgcacccggcccaaggccgccggactcccgggcgccgcgctgccgctccgcaagcgcccgctgcgcgcgccctccccggagcccgccgctccccgcggcgctgcgggccttgtcgtccccctggaccctctgcgcggcggctgcgacctgccggcggtccccgggcccccccacggcctggcccggccggaggcgctttactaccccggagccttactgcctttgtaccccactcgggccatgggctccccgtttcctctggtgaacctgcctacacccctataccccatgatgtgccccatggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctcccagtctccccccagggacccccctggattccccatggctcctcccaatttcttccttccttccccatctccacccgccttcctgccctttgctggggtcctccgaggccctggccggccggtgcccccctccccagctccaggaggcagctgagggggatgggggggcagatcttggactcatgaggaggggcccccctgccctgtggggtcaacccttctggaaactgtgaagatctcactctgccccccccccccatcttcgggaccaggatttgcacagaagcacatgcacctacccatacaccccctcttctgagcacagatgttcccccatctcgctccctcccaggactctgaccccagcattctcaggcaccagtccctgtccggaatgccacccacatcttccatttccatgtcccctcccagagctggtggacccagggaacagccactcccctccactctctaccagataactgaggaggggagaggtgggccgtaacgggcacggatcacgatgtaaattattaagcattttggttggatttcttttgtaataaactatttttgtaccata

SEQ ID NO: 110900 - DNA, 923 bp, Homo sapiens
  Payload ID: 1755
  Gene Symbol: BCL3
  Gene Name: B-cell CLL/lymphoma 3
  ENST ID: ENST00000444487
  CDS Start-End: 1-923
ggaacaccccctttctgctgacatcgccatggccacccgtgcagatgaggacggagacacgcctctccatattgctgtggtgcagggtaacctgccagctgtgcaccggctggtcaacctcttccagcaggggggccgggagctcgacatctacaacaacctacggcagacaccgctccacctggctgtgatcaccacattaccgtctgtggtccggctcctggtgacagctggtgccagccccatggcgctggaccgccatggccagacggccgctcacctggcgtgcgagcaccgcagcccgacctgcctgcgagccctgctggacagcgcagctccgggcacgttggacctggaggcccgcaattatgacgggctcaccgccctgcacgtggcagtgaacaccgagtgccaagaaaccgtgcagctcttgctagagcgcggtgccgacatcgacgcagtggacattaagagcggccgctccccgctcatccacgccgtggaaaacaacagccttagcatggtgcagctgctgctgcagcacggcgccaacgtgaacgcgcaaatgtactccggcagctccgccctgcactcagcgtccggccgcgggctcctcccgctggtgcgcacgctggtccgcagcggcgctgacagcagcctcaagaactgccacaacgacacgccgctcatggtggcgcgcagccgcagggtgagccggggcagctgtggacatgccccttgcacacgtgtgtccgcgggctggttgcaggtcatcgacatcctgagggggaaggccacccggcctgcttccacctcccagccagacccctcccctgaccggagcgccaacacctcccccgagagcagcagccgcctcagctccaatggtcttctctccgcatcaccatcctcctcaccctccc

SEQ ID NO: 110901 - DNA, 2710 bp, Homo sapiens
  Payload ID: 1756
  Gene Symbol: BCL6
  Gene Name: B-cell CLL/lymphoma 6
  Uniprot ID: P41182
  ENST ID: ENST00000232014
  CDS Start-End: 530-2650
gccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatact

SEQ ID NO: 110902 - DNA, 3569 bp, Homo sapiens
  Payload ID: 1756
  Gene Symbol: BCL6
  Gene Name: B-cell CLL/lymphoma 6
  Uniprot ID: P41182
  ENST ID: ENST00000406870
  CDS Start-End: 368-2488
ataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactgg

SEQ ID NO: 110903 - DNA, 4178 bp, Homo sapiens
  Payload ID: 1756
  Gene Symbol: BCL6
  Gene Name: B-cell CLL/lymphoma 6
  ENST ID: ENST00000419510
  CDS Start-End: 1049-1216
tctcattgacagccctgctccttggagattgtttttgtgggtagtcttgtgtgtggcattggtggaatggctgaatctaggagacgcggcgtgtccagaacttgctggaaattggttttgagattttgggcaaggcctctcacccggagcctcagttccctccctaataaagcagggctgttataaggataagatgcaatcttgagggggtgggaaaggactaagagctctgtaaaaatacaaaccaaatgctggtggtgcttccacacctgcggcatttggggtgggggtggtgacaacattgcccacactcaacccacacactcaggagttggggggggctggttcttaagacgagttggcttgcaaaggagtgaacttgagaaggacctgcgcctcgtgtatgtacatttgtttttggccaggcagaggcttacggtgaaaagcccaaggcccagctgacagtggacacaggggaatttgtttgtttgtttcaatccgcatctggagtgagtcattgccacttgtcatggtgaaatggcaaatctgggcttcctgtggttccagaagcctgcgactggaaatccacaagcgagctggtggttgaagctggttaaagaacagcctaggtattccagaagtgtttgaggatcccttccatgaaggaagagaggaaagtttttaagtaaacctcccactcccatgtgtcttcagctttcttttgcaaaggagaaaatccttgaagtttggtaaagaccgagttagtctatctctctttgcctatctcgagttgggctggggagaggaggagataggttcttttgtctttttctgtcttctcccttccccacttccttccctccagtccccactcactcacatgcacacactaaccttggagccgatgggattgagtgactggcacttgggaccacagagaaatgtcagagtgtttggttacagactcaaggaaacctctcattttagagtgctcatttggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtgagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaa

SEQ ID NO: 110904 - DNA, 2003 bp, Homo sapiens
  Payload ID: 1756
  Gene Symbol: BCL6
  Gene Name: B-cell CLL/lymphoma 6
  Uniprot ID: P41182
  ENST ID: ENST00000450123
  CDS Start-End: 25-1977
aagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtct

SEQ ID NO: 110905 - DNA, 709 bp, Homo sapiens
  Payload ID: 1756
  Gene Symbol: BCL6
  Gene Name: B-cell CLL/lymphoma 6
  ENST ID: ENST00000438077
  CDS Start-End: 398-709
tcctggcggctgccggggccggcagcttcctggaaagttacttcttgttggagccggcaataggcaaagtgtgttctgtgaaatccgcagagccgagattgactacgttccgggaatgagagggctgtgtcattcccctcattgcctgctgcattgacggcgtaacaggaaaaaaaaaaaaaaaaaaaaaaaggcatacacacaatgttagctaccgaggtgcaccaaaagttttatttgaatgtaactaaattaagggccgccacggtcataccacaaagcctccgtcgcgccttgcggggggcttcgaggtggatcgcccaggggcgggcagtccctggaagacaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggct

SEQ ID NO: 110906 - DNA, 454 bp, Homo sapiens
  Payload ID: 1756
  Gene Symbol: BCL6
  Gene Name: B-cell CLL/lymphoma 6
  ENST ID: ENST00000430339
  CDS Start-End: 90-454
gttaaatcaatttctgtttgctttcttctcttctctgtaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccg

SEQ ID NO: 110907 - DNA, 3399 bp, Homo sapiens
  Payload ID: 1756
  Gene Symbol: BCL6
  Gene Name: B-cell CLL/lymphoma 6
  Uniprot ID: P41182
  ENST ID: ENST00000621333
  CDS Start-End: 366-2318
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggttttgagcaaaattttggactgtgaagcaaggcattggtgaagacaaaatggcctcgccggctgacagctgtatccagttcacccgccatgccagtgatgttcttctcaaccttaatcgtctccggagtcgagacatcttgactgatgttgtcattgttgtgagccgtgagcagtttagagcccataaaacggtcctcatggcctgcagtggcctgttctatagcatctttacagaccagttgaaatgcaaccttagtgtgatcaatctagatcctgagatcaaccctgagggattctgcatcctcctggacttcatgtacacatctcggctcaatttgcgggagggcaacatcatggctgtgatggccacggctatgtacctgcagatggagcatgttgtggacacttgccggaagtttattaaggccagtgaagcagagatggtttctgccatcaagcctcctcgtgaagagttcctcaacagccggatgctgatgccccaagacatcatggcctatcggggtcgtgaggtggtggagaacaacctgccactgaggagcgcccctgggtgtgagagcagagcctttgcccccagcctgtacagtggcctgtccacaccgccagcctcttattccatgtacagccacctccctgtcagcagcctcctcttctccgatgaggagtttcgggatgtccggatgcctgtggccaaccccttccccaaggagcgggcactcccatgtgatagtgccaggccagtccctggtgagtacagccggccgactttggaggtgtcccccaatgtgtgccacagcaatatctattcacccaaggaaacaatcccagaagaggcacgaagtgatatgcactacagtgtggctgagggcctcaaacctgctgccccctcagcccgaaatgccccctacttcccttgtgacaaggccagcaaagaagaagagagaccctcctcggaagatgagattgccctgcatttcgagccccccaatgcacccctgaaccggaagggtctggttagtccacagagcccccagaaatctgactgccagcccaactcgcccacagagtcctgcagcagtaagaatgcctgcatcctccaggcttctggctcccctccagccaagagccccactgaccccaaagcctgcaactggaagaaatacaagttcatcgtgctcaacagcctcaaccagaatgccaaaccagaggggcctgagcaggctgagctgggccgcctttccccacgagcctacacggccccacctgcctgccagccacccatggagcctgagaaccttgacctccagtccccaaccaagctgagtgccagcggggaggactccaccatcccacaagccagccggctcaataacatcgttaacaggtccatgacgggctctccccgcagcagcagcgagagccactcaccactctacatgcaccccccgaagtgcacgtcctgcggctctcagtccccacagcatgcagagatgtgcctccacaccgctggccccacgttccctgaggagatgggagagacccagtctgagtactcagattctagctgtggtgagaaaccctatcgttgcaacatctgtggggcccagttcaaccggccagccaacctgaaaacccacactcgaattcactctggagagaagccctacaaatgcgaaacctgcggagccagatttgtacaggtggcccacctccgtgcccatgtgcttatccacactggtgagaagccctatccctgtgaaatctgtggcacccgtttccggcaccttcagactctgaagagccacctgcgaatccacacaggagagaaaccttaccattgtgagaagtgtaacctgcatttccgtcacaaaagccagctgcgacttcacttgcgccagaagcatggcgccatcaccaacaccaaggtgcaataccgcgtgtcagccactgacctgcctccggagctccccaaagcctgctgaagcatggagtgttgatgctttcgtctccagccccttctcagaatctacccaaaggatactgtaacactttacaatgttcatcccatgatgtagtgcctctttcatccactagtgcaaatcatagctgggggttgggggtggtgggggtcggggcctgggggactgggagccgcagcagctccccctcccccactgccataaaacattaagaaaatcatattgcttcttctcctatgtgtaaggtgaaccatgtcagcaaaaagcaaaatcattttatatgtcaaagcaggggagtatgcaaaagttctgacttgactttagtctgcaaaatgaggaatgtatatgttttgtgggaacagatgtttcttttgtatgtaaatgtgcattcttttaaaagacaagacttcagtatgttgtcaaagagagggctttaatttttttaaccaaaggtgaaggaatatatggcagagttgtaaatatataaatatatatatatataaaataaatatatataaacctaaaaaagatatattaaaaatataaaactgcgttaaaggctcgattttgtatctgcaggcagacacggatctgagaatctttattgagaaagagcacttaagagaatattttaagtattgcatctgtataagtaagaaaatattttgtctaaaatgcctcagtgtatttgtatttttttgcaagtgaaggtttacaatttacaaagtgtgtattaaaaaaaacaaaaagaacaaaaaaatctgcagaaggaaaaatgtgtaattttgttctagttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaaatatagctgtacaaatataagaataaaatgttgaaaagtcaaactgg

SEQ ID NO: 110908 - DNA, 3555 bp, Homo sapiens
  Payload ID: 1757
  Gene Symbol: BCL6B
  Gene Name: B-cell CLL/lymphoma 6, member B
  Uniprot ID: Q8N143
  ENST ID: ENST00000293805
  CDS Start-End: 93-1532
agataaaggagccgaggccaagaggggagagagaccccgccccccttaagaagagaagccgcggcccctgcaggacgggggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgccacctatttgcagatggagcacgtggtccaggcatgccaccgcttcatccaggccagctatgaacctctgggcatctccctgcgccccctggaagcagaacccccaacacccccaacggcccctccaccaggtagtcccaggcgctccgaaggacacccagacccacctactgaatctcgaagctgcagtcaaggcccccccagtccagccagccctgaccccaaggcctgcaactggaaaaagtacaagtacatcgtgctaaactctcaggcctcccaagcagggagcctggtcggggagagaagttctggtcaaccttgcccccaagccaggctccccagtggagacgaggcctccagcagcagcagcagcagcagcagcagcagtgaagaaggacccattcctggtccccagagcaggctctctccaactgctgccactgtgcagttcaaatgtggggctccagccagtaccccctacctcctcacatcccaggctcaagacacctctggatcaccctctgaacgggctcgtccactaccgggaagtgaatttttcagctgccagaactgtgaggctgtggcagggtgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcgggagagaagccgtataagtgtgagacgtgcggctcgcgctttgtacaggtggcacatctgcgggcgcacgtgctgatccacaccggggagaagccctacccttgccctacctgcggaacccgcttccgccacctgcagaccctcaagagccacgttcgcatccacaccggagagaagccttaccactgcgacccctgtggcctgcatttccggcacaagagtcaactgcggctgcatctgcgccagaaacacggagctgctaccaacaccaaagtgcactaccacattctcggggggccctagctgagcgcaggcccaggccccacttgcttcctgcgggtgggaaagctgcaggcccaggccttgcttccctatcaggcttgggcataggggtgtgccaggccactttggtatcagaaattgccaccctcttaatttctcactggggagagcaggggtggcagatcctggctagatctgcctctgttttgctggtcaaaacctcttccccacaagccagattgtttctgaggagagagctagctaggggctgggaaaggggagagattggagtcctggtctccctaagggaatagccctccacctgtggcccccattgcattcagtttatctgtaaatataatttattgaggcctttgggtggcaccggggccttcattcgattgcatttcccactcccctcttccacaagtgtgattaaaagtgaccagaaacacagaaggtgagatcacagctctgctggcagagattactagcccttggctctctcgtttggcttgggtattttatattatttctgtcataacttttatctttagaattgttctttctcctgtttgtttgcttgttagtttgtttaaaatggaaaaaggggttctctgtgttctgcccctgtaattctaggtctggaacctttatttgttctagggcagctctgggaacatgcgggattgtggaattgggtcaggaaccctctctggtattctggatgttgtaggttctctagcagtctagaaatggatacagacatttctctgttcttcaagggtgataggaaccattatgttgagcccaaaatggaagtaataataaatgcctcctggaggctgtgggtgtgggggattctgtatctggattccgtatcactccaagtggaggctggcaggtttttctgcaagatggtccagaatctaaaatgtcccattaatctggtcacttgggtttggctctgctgtatccatctatagtggtagagacccaccagggctcaagtggagtccatcatcctcccacgggggcctgttcttagcactgagttgatcgctccatgggggagagatcagacattccttatcagagatgatgtgaccttttctgactctgcccagtctctatgaatgttatggcctagggaagaatcatgaaactctttagcttgattagatggtaaacagtgttaacccatcctttactacagaggcatatgggtttgaatgttacctggggttctctctattgagttgagccccttcttcctttagtgggttttggacatcttctggcaagtgtccagatgccagaaccttcttttcctctagaagggatggtgcttggtaaccttaccttttaaaagctgggtctgtgacctggtcttcccatccctgcattcctgtctggaaccagtgaatgcattagaaccttccataggaaaagaaaaggggctgagttccattctgggtttgctgtagtttggttgggattattgttggcattacagatgtaaaagattgactagcccataggccaaaggcctgttctagttgaccaagtttcaagtaggattaagaggttggttgaggggtgcagtttctggtgtaggccaggtaggtagaaagtgaggaacagggttgcctcttggctgggtggagtctctgaaatgttagaagaagcgctgaagccttgattgatagttctgccccttgttgccctggggcttatctgattatgggacgagggtagaaagtaagaagcacttttgaatttgtggggtagaacttcaacaataagtcagttctagtggctgtcgcctggggactagtgagaaagctactcttctccctcttccctctttctccccatggccccactgcagaattaaagaaggaagaagggaaggcggaggagtctataagaaggaatcatgatttctatttagcagattggatgggcaggtggagaatgcctgggggtagaaatgttagatcttgcaacatcagatccttggaataaagaagcctctctgtgc

SEQ ID NO: 110909 - DNA, 865 bp, Homo sapiens
  Payload ID: 1757
  Gene Symbol: BCL6B
  Gene Name: B-cell CLL/lymphoma 6, member B
  ENST ID: ENST00000537931
  CDS Start-End: 1-408
tgctcatcggggctggactccttggttcctggggacgaagacaaaccctataagtgtcagctgtgccggtcttcgttccgctacaagggcaaccttgccagtcatcgtacagtgcacacaggggaaaagccttaccactgctcaatctgcggagcccgttttaaccggccagcaaacctgaaaacgcacagccgcatccattcgggagagaagccgtataagtgtgagacgtgcggctcgcgctttgtacaggtggcacatctgcgggcgcacgtgctgatccacaccggggagaagccctacccttgccctacctgcggaacccgcttccgccacctgcagaccctcaagagccacgttcgcatccacaccggagagaagccttaccacgaaccagtgacttcatgaagtttctccggagccacctgcatcctgctgctctgaagtcacttcctgcctgaggtgtggaggctgcagggagaaaccaggaagccactaataatatcaagaggccggggcgtgcatctgtgctggagatcttaatgctggcgacatgcctccatcaccaaggaagatggataagagttgggtcccgtaaagaccacaggggctggaggtggcactgagaagactgagttagaactaacgggccagcccaccctcccccagcaagggtatcttgaatctatccagggtccagtgcatgcatctctcccaccctttcccctgtcctgtgtgtgtgctgggtgcggaggtcactaattctgatattaccttcctctgggccttaaattcctcatctgtgaaaaagtcagttaccatgatctctgcagctacctccaacattgaaagtttgtagttgtct

SEQ ID NO: 110910 - DNA, 459 bp, Homo sapiens
  Payload ID: 1757
  Gene Symbol: BCL6B
  Gene Name: B-cell CLL/lymphoma 6, member B
  ENST ID: ENST00000576705
  CDS Start-End: 59-459
aagaacaagagactgagggagccagactcctgggtcccccaagagggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgccacctatttgcagatggagcacgtggtccaggcatgccaccgcttcatccaggccag

SEQ ID NO: 110911 - DNA, 529 bp, Homo sapiens
  Payload ID: 1757
  Gene Symbol: BCL6B
  Gene Name: B-cell CLL/lymphoma 6, member B
  ENST ID: ENST00000573503
  CDS Start-End: 196-529
caagggagcgagggtgtcgtagagggcagaatgaacaagaagaattaggagggaggctgcgtgtgccggggctaggggctggaagtcctggctctagttgcacctcggaaggaaaaggcaaacagaggagggaaggcgtcttaggactgcctggatccagagcactttccacggcctctacaggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcc

SEQ ID NO: 110912 - DNA, 2581 bp, Homo sapiens
  Payload ID: 1758
  Gene Symbol: BCL7A
  Gene Name: B-cell CLL/lymphoma 7A
  Uniprot ID: Q4VC05
  ENST ID: ENST00000261822
  CDS Start-End: 207-839
actgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaa

SEQ ID NO: 110913 - DNA, 6247 bp, Homo sapiens
  Payload ID: 1758
  Gene Symbol: BCL7A
  Gene Name: B-cell CLL/lymphoma 7A
  Uniprot ID: Q4VC05
  ENST ID: ENST00000538010
  CDS Start-End: 2671-3366
cccagcctagatttctttttattatgatcaaatacacataaaattgaccattgtaaccatttaaaagtgtacaattcagcgtcattaagtacattcacattgttctgcaaccatcaccactatctcattccagaactttcctatcactccgaaaggaaaccccacatccgttagcagtcactcctgctctccctcccccttgcctctggcaaccaccaatctgatatctgtctttatggattcgcctagttgtagatatctcccgcaaatggacttacgcatatttatccttttgtgactggcttctttcacttagcgtgtttcaaggttcacccatgttgtagcatgtattcattcccttttatggctgaataatattccattgtgtggatagacacatttatctgttcctcagtcactatttgaattctgacataatattttcctattttaaattttaagatacatttttttaaagtttcatgtggcccaaagcacatacctattgatctcacatatctctgtgagatctgttttatgacctgctgttgcatattttcccagaaaattctcggaacgattctctgaagtccttctttctctttctcttttttttctttttctttctctctttctttttttgttttgttttgttttattttgttttgttttgtttttttgagattcagttttgctctgttgcccaggctggagtgcaatggcatgatcattgcacctctgcctcccaggttcaagcattttcctgcctcagcctcccgcgtagctcagattacaggcctgcaccaccacgcccagctaatttttgtatttttagtagagacagggtttctccatgttggccaggctggtctcgaactcctgacctcgtgatctgcccacttcggcctccaaagtgctgggattacaggcatgaaccaccgcgcccggccttttttttttttctgagacagggtctcactctgtctcccaggctggagtgcagtggctggatctctgctcactgcaacctccgtctcccaggttcaagcgagtctcctgcctcagactcccgagtagctgcgattacaggagcccaccaccgcgcccggctaatttttgtatttttagtagagacggggtttcacccaccatgttggccaggctggtatcgaactcttaacctcaagtgatccacccgcctcggcctcccaaagtgctggtattacaggcatgagccaccgcgcccggccagtatttgttcttttcttcatttttcacgtcaggagactgcgtttcagaatagtaaaaacaaatgcctaggaaaaggcctgcggtctctccatttccacagtagcgtgttccccaaagaccaaaccctcaggggaaacgtctagaatgagtaacaacttaaggctgcaaccttaaactttcccaggactcagtttccccagctgtgaaatggctgctgtcgggctgtcatctccaggcccggggcgctgacatttgggccactctcggtctccctcttcattctgggcgcgcattagctctggtccggccggttccgctgcagctgaacagcaagatgcggcacccaggttaccctgatcatcgcagatttctccccggggctctgttctgaggcctcaaaagtgctccttgtagatgggaccaggggtcatttgggcagtagcagcgcctggtctcagtctggtactgaagtcaggaatggcttaaggtgaaatcgtggtcctctggtgaagctcagcgaagaccccctcgccttgtttatgacaagagaacttctgggggcgggaggaagagtccctgttacgatgctgatcatcattgagcttttgctgagcagaaaactctttagtactcaaggtcgagagtctctggtggtctgcctggcaccaggcaccttcctacaaccctagttttccaaaaggacaaagcctggggcaggcgacgtcctagctcgcatttgaacagggccgcgggccagcagagatgcgcgatgcccaactctttccaagagcacctcgcgtcccgaaccggtgccttcaactcggagaagtcaagagacccgcaagaaacttgcacgactgcacccgccgccgcgctctgggggctgggcaggggcagctgggctggctcccggggaacgcgacccccccgcgccccgcagaccggctgtctcccatggacccctcggcacctgcagcctccgaggaagggtcagcgcgcgtgtccgcacgcccgcccccaccgcgcgcccagagccgggggtcgccgtgcgcccttcgccacctccccaggagggcgtccggggcgtcccctctgggggcgcaggaggcccgggggcgctgcccggtggccgcggcgcccggaggccgcactgccggcggcggcggcggcgcggctccccctgctctgtgcagctgccgcccggcgcttgcgcactgggccaggcgcgcggcggccccgggctttgtgtgtgtgtgtatgtgtgtgtgtgtgtgtgtgtgtgtgtgagtgtgtgcgtgtgagagtgcgagtgtctgtgcgcgagtgagtgagcggcgggcgggcgcgagtgtggccgccgcggagcgcgagcaggacccggcgggcgcgctccccagcctccgtctccccgccggaaccatgtcgggcaggtcggttcgagccgagacgaggagccgggccaaagatgatatcaagagggtcatggcggcgatcgagaaagtgcgcaaatgggagaagaaatgggtgaccgttggtgacacatccctacgaatctacaaatgggtccctgtgacggagcccaaggttgatgacaaaaacaagaataagaaaaaaggcaaggacgagaagtgtggctcagaggtgaccactccggagaacagttcctccccagggatgatggacatgcatgacgataacagcaaccagagctccatcgcagatgcctcccccatcaaacaggagaacagcagcaactccagccccgctccagagcccaactcggctgtgcccagcgacggcaccgaggccaaggtggatgaggcccaggctgatgggaaggagcacccaggagctgaagatgcttctgatgagcagaattcacagtcctcgatggaacattcgatgaacagctcagagaaagtagatcggcagccgtctggagactcgggtctggccgcagagacgtctgcaatctctcaggtacctcgctcgaggtctcagaggggcagccagatcggccgggagcccattgggttgtcgggggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaaggctgtctccttaaggcactgagtgggccggggaggctgggagccggcggcaggattagctggtgctgaactttctctcataggacgtcgcttggatttcaaatccacggtcacctgctgccctttgcctcccccgacgccccagcctgtgccccggagaggcaggatcgcagtggtcagaatccacgtgctttcctattctcaggctgttctgactctgagccaacagctggaccgtgtctcatccccagaacatgccgtctgtccccaccggggagtgggccttgatggccgggcctcgaaggccacaaacaaggcgtcgaggaattggaaagatttgcacaccctccagaaaggagagacgcaatctcccctccctcccatcccccaccttcgctggaacagcttcctctcactgaacggagacgcccccttggacgaactgcctaatcgtttggttctgaggcctggtttgctcttaattaatatatgaactcctcagaccttaaaccttttcctaagctttctttactgcactggagttctgactccctttgagttgtgtgttactgggggtggggtggggtcatgggttttgttgtttttgggggctaattggtgcatattcaggtaccacctttgacgtgtggctctttctcctgaccatcatgggaagtgtctgctggattccattttctaagagtttctgagggtgaggctcttatttttttttttaagggatcctgtctatttcctgcacttcgagaagaatcaaaatgttcctgaatttcaaatacctcatgcaaaatgtctcctgaaataagggaaaaaaaaaaaaccacaactttgaaaatcttaatgttgaagttagcaatgccgaaaggtttctgtcttaaaaaaaaaaatccttgtacttatcaattttgccccttaggcagtcagttttgttgagaactgtgtcctgcatcctggcgcagaacctacctgatgcggttcctctccacgcatctcgaggcggcgttacctccagattccgtagagttagagtcacatttttctttgcagcgaaactccatcttggtgagagatgaatttggatatttatttccttctctgtttttgggaaacgagaggctacaaccaagacagctgaaggagaatgaaacacacacatccacagaaacagagaggcgtaggtggccctgccgttgaccgcagcctctctggacaggcaaggggagttggcgcaggtgaggactcagacgacgtccaccgtcccaaggctgtcactagtatttctctgaagtgcctgaaggtaggaatgggccggcgattgggaccagctgggccccaccacggccacgccaggcaaagcgccagcagccctgcactccacgctggccaagaaggccttccacgcagaatgacaagactgcaaaaatccgatgtgcttccttccctggcgcagtcgctcctcgagccgctgccccccacccaccctgcacccctcgccctccccccaccacagaatctaagacctttcagcttcgagccagggggcgggggatcccgagcaaaagccttccgtggacatcaggccccgtggcctcaagggctcccagggcaaacctaattccccccaaaacgtgaagtcggggaagctgcggctacacattccacaaagtgctggcacttacacccacaacccggaaggctgtggaccgattcctctagggtggtgacctcccattagcaaacggtgtcatggtttggaatgttcattatcgccaagaacctggttagaggcataaagaccttttttcaccgttacctaattttttcccctttcaagaattttttttttttttggtgtgttgtacagcagtataatttttcacttatttattccatcagtagatatggtttgtacaatgtacaattgtttcatttcagaaaataaaaatttcaaatcatgaa

SEQ ID NO: 110914 - DNA, 6247 bp, Homo sapiens; identical to SEQ ID NO: 110913
  Payload ID: 1758
  Gene Symbol: BCL7A
  Gene Name: B-cell CLL/lymphoma 7A
  ENST ID: ENST00000635191
  CDS Start-End: 2671-3366

SEQ ID NO: 110915 - DNA, 2581 bp, Homo sapiens; identical to SEQ ID NO: 110912
  Payload ID: 1758
  Gene Symbol: BCL7A
  Gene Name: B-cell CLL/lymphoma 7A
  ENST ID: ENST00000635403
  CDS Start-End: 207-839

SEQ ID NO: 110916 - DNA, 1975 bp, Homo sapiens
  Payload ID: 1759
  Gene Symbol: BCL7B
  Gene Name: B-cell CLL/lymphoma 7B
  Uniprot ID: Q9BQE9
  ENST ID: ENST00000223368
  CDS Start-End: 425-1033
ggaggacagagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatg

SEQ ID NO: 110917 - DNA, 1458 bp, Homo sapiens
  Payload ID: 1759
  Gene Symbol: BCL7B
  Gene Name: B-cell CLL/lymphoma 7B
  Uniprot ID: Q9BQE9
  ENST ID: ENST00000411832
  CDS Start-End: 94-531
tgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaa

SEQ ID NO: 110918 - DNA, 985 bp, Homo sapiens
  Payload ID: 1759
  Gene Symbol: BCL7B
  Gene Name: B-cell CLL/lymphoma 7B
  ENST ID: ENST00000455335
  CDS Start-End: 188-829
gacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgacggaatctcgctctgtcacccaggctggagtgcattggcgcaatctcggctcactgcaacctctgcctctcaggttcaagcaattctcctgcctcagcctcctgagtagctgggactacagggagaagaagtgggtgactgtgggtgacacgtccctgaggatatttaagtgggttcctgtgacagacagcaaggagaaagaaaagtcaaaatcgaacagttcagcagcccgagaacctaatggctttccttctgatgcctcagccaattcctctctccttcttgaattccaggacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgta

SEQ ID NO: 110919 - DNA, 848 bp, Homo sapiens
  Payload ID: 1759
  Gene Symbol: BCL7B
  Gene Name: B-cell CLL/lymphoma 7B
  ENST ID: ENST00000448175
  CDS Start-End: 77-313
ggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagagacagagtctggctatgttgtccaggctggttgtgaactcctggcctcaagcagtcccccagccttgacctcccaagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacct

SEQ ID NO: 110920 - DNA, 887 bp, Homo sapiens
  Payload ID: 1759
  Gene Symbol: BCL7B
  Gene Name: B-cell CLL/lymphoma 7B
  ENST ID: ENST00000454871
  CDS Start-End: 32-298
tgccccggcccccgccgctcccgccgccgccatgtcgggccggtcggtccgggcggagacccgcagccgggccaaggacgacatcaagaaggtgatggcggccatcgagaaagtgcggaaatgggagaagaagtgggtgactgtgggtgacacgtccctgaggatatttaagtgggttcctgtgacagacagcaaggagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggaggagccctccctgccctcctcggaagttgctgatgaacctcctaccctcaccaaggaagaaccagttccactagagacacaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagaga

SEQ ID NO: 110921 - DNA, 1740 bp, Homo sapiens
  Payload ID: 1760
  Gene Symbol: BCL7C
  Gene Name: B-cell CLL/lymphoma 7C
  Uniprot ID: Q8WUZ0
  ENST ID: ENST00000215115
  CDS Start-End: 1017-1670
catcatgcgacttgtctatgttgctgtgtgtagccgggcatgtcaatcccgttgctgtgtctatgtgcatggtagtgagtagggcatcattcattttccattctgttgatgggttatttccagtttggggctgttatgaaagggctctgaacattcccatgcaccctcttgatgctcacacctacacatttctgctgggtgttgacagcctaggagtggaactgctggatcacagaggtggcatatgttcggcttcattagaaaactgccagttttccaaaatgtctctaccaatttacactcccccagaaatacaagagaggtccagtcgctctactttctcgcctccacacggtgcggtctttttcactttagccattctggtggtggagacccactcgtattcgcagcgcctggagcgtaattggcactcagttaacaagactgttgaatgaatggatgactgagtaagttgggcggtgtagaccaacagcctggcgagggcggacacacgcacgcactccacacacagcgtttcgcggacacccaccgcggctcacgcagcgcaggacacagaccctgtcgcgcaccccgcgcccacgtggtctgaacacacggcctcggccctgcctcgcgcgtccggtcgcaactcccgctctccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaa

SEQ ID NO: 110922 - DNA, 2409 bp, Homo sapiens
  Payload ID: 1760
  Gene Symbol: BCL7C
  Gene Name: B-cell CLL/lymphoma 7C
  Uniprot ID: Q8WUZ0
  ENST ID: ENST00000380317
  CDS Start-End: 359-1087
tccgtccccaactcgcgcgtccgtccccaactcccgctctcggcggcgggcagggggcgctgagcgtccaggcgctccaagggggcgggcccgggtcggggcggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggattcgggagtgagaatgacgaggagagcccttcacgagaaggggctgaagacagagcccctcaggaggctcctgcccaggaggggcctccggacaaatgtccggcccagttccatggcggtgccggacaccagagctcccgggggaggcagcaaggccccgagggcacccagaacaatcccccagggtaaggggaggtgagtgggctccccaagcaagccaagacccctaaagcctcccttggctgccccaagatccagccactacctgtgccccgagggcggaaagagcttcccagctcacccaccgcggtaacatcggagggcgagcggccccacacctgcccgaacctaaggccacagcacccatctggctcgccactggcgcccgaatgcatgggaagggcttagggcagaactcggaccacatccagtgcctgaggccgccttgctagaggcctaggggaggggtgcactgggctgcctcgcccacctcctcacgcacccatgcggccaccctcccagcggtctgagtgtgccatgcgaggcgcctgccaccccgggagaggcgccgagtcccgagtcctgccggcactgagcctccgggtccacagcgggcaagggccgtggcggggacaagcgcaggggacccgccggcctcccgccttctgcagcaccacgagatgcccacgtggcacctggacgtccatgcatatgttgaggcccgtgcacgcgcagagaccccagcgcagaagccgccccgcacgccagggcttatgtatgccagcgctgggagacctccagcgcccgaggacatacggcaagtggttccaccagggtgtcagcctagcaggccaacctgggaacccatgtggacaagcggcctttcagcccaggcgcccgcctcgggtggaggcgtggagacttctggcgcagccctgagctggtggcctaacctacctggaaaatcctagcccgagaagcagcgcgagtgagccttttgggtggttccaaggcccttcaccaagctctcacttcctgacttcaccgttgggtctgttgtactaggaaataataacgcctcccatttatcaagggtttactctgtaccaggcattgtgactgatgtaatttagttctcactgcatccctgtggcatggatattctcattatctgcattttgcagatggagaaattgagtctctgagaggttaaggaacctgcccaaagtcagcaatgcagtaccacttcttgtgctgggacacagcggggttaaggccgtgggttaacagggcctccatttatggagagcattcatttttctctggtgaattacagaaaacgctttctacactgaagtgagtagatactccctgggatgaaagtcaacattcgtaccaatgattgagatgacagaaatttcacgcttcaagccaatgctttaggttcagcccatggaattctggaatgaccttttctcagtcgtcaccagggtgatgttggtgaaggaagctccattccag

SEQ ID NO: 110923 - DNA, 1603 bp, Homo sapiens
  Payload ID: 1760
  Gene Symbol: BCL7C
  Gene Name: B-cell CLL/lymphoma 7C
  ENST ID: ENST00000572628
  CDS Start-End: 1-880
ggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggagcgaaggcgggcaggtggcggggcagagagatcccgtggccgggaacgtcggggcaggggcgccagtccccgagggggtggccctctcatcctgctggatcttaatgatgagaacagcaaccagagtttccattcggaaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgagactatggaaatgatgttagacaaaaagcaaattcaagcgattttcttattcgagttaaaaatgggtcataaagcagtggagacacttcgcaacatcaacaacacacttggcccaggaactgctaatgaacatatagtacagtggtggttcaagaagttttgcaaagaagacaagagccttgaagatgagaagcatagtgtctggccatcggaagttgacaatgaccaactgaaagctctcattgaagctgatcctgttaaaactacacaagaagttgcccaagaactcaaccatcgaccattctatggccgtctggcatttgaagcaaattggaaaggtgaaaaagctcaataagtgggtgcctcatgaccttaccaaaaattaaaaaaatcgtcattttgaagtgtcatcttctcttattctatgcaacaacaacgaaccatttcttgatcagattgtgatgtgtgacaaaaagtcgattttatatgacaaccggcaacaaccagctctgtggctgtactgagaagcagctctaaagtacttcccaaagccaaccttgcaccaaaaaaaggtcacggtcactgtttggtggtctgctgctggtctgatccactgcaactttctgaatcccagtgaaaccattacatctgagaagtatgctcagcaaatcgatgagatgcaccaaaaactgcaaggcctgctgtggcactgctcaacagaaagggcccagttattctccatgacaacaaccacacatcgcataaccagcgcttcaaatattgaggccgggtgcggtggctcacgcctgtaatcccaacattttgggaggccaaggtggacggatcacttgaggtcaggagttcgagaacagcctggccaacatggtgaaacctgtctctactaaaaatacaaaaattagctgggtatggtagctggcgcctgtaatcccagctactcgagaggctgaggcaagagaactgcttgaacccggaaggtggaggttgcgatgagccaagattgtgccactgcactccagcctgggcgacagagtgagacttcatttcaaaaaaaaaaaaa

SEQ ID NO: 110924 - DNA, 1206 bp, Homo sapiens
  Payload ID: 1760
  Gene Symbol: BCL7C
  Gene Name: B-cell CLL/lymphoma 7C
  ENST ID: ENST00000574418
  CDS Start-End: 257-571
ggggccggccgggcttccaggcctgggctctggccgcccgcgccaccgggccgctccggggacaggccggggcggggcgcggcggcaggaaacggggcggggacttgcggaggcgttggggacgagagagggcgcggccaactccaggggggacggcaggccgagagcgcggcgcccgggcctggcgcggagcctgagcccgccggacgggaggcggccccgccgcgggctcggccccggccccagccccgccagcatggccggccggactgtacgggccgagacccggagccgggccaaggatgacatcaagaaggtgatggcgaccatcgagaaggtccggagatgggagaagcgatgggtgactgtgggcgacacttcccttcgtatcttcaagtgggtgccagtggtggatccccaggaggaggttccctgcaaaagggcacagagcccagtcctgggggcaccccccagcccagccgccctgtgtcacctgccggacccccagaaggggtccctgaggaggctcagcccccacggctgggccaagagagagatcccgggggcataactgctggcagcaccgacgaacccccaatgctgaccaaggaggagcctgttccagaactgctggaagctgaggattcgggagtgagaatgacgaggagagcccttcacgagaaggggctgaagacagagcccctcaggaggctcctgcccaggaggggcctccggacaaatgtccggcccagttccatggcggtgccggacaccagagctcccgggggaggcagcaaggccccgagggcacccagaacaatcccccagggtaaggggaggtgagtgggctccccaagcaagccaagacccctaaagcctcccttggctgccccaagatccagccactacctgtgccccgagggcggaaagagcttcccagctcacccaccgcggtaacatcggagggcgagcggccccacacctgcccgaacctaaggccacagcacccatctggctcgccactggcgcccgaatgcatgggaagggcttagggcagaactcggaccacatccagtgcctgaggccgccttgctagaggcctaggggaggggtgcactgggctgcctcgcccacctcctcacgcacccatgcggccaccctcccagcggtctgagtgtgccatgcgaggcgcctgccaccccggga

SEQ ID NO: 110925 - DNA, 6278 bp, Homo sapiens
  Payload ID: 1761
  Gene Symbol: BCL9
  Gene Name: B-cell CLL/lymphoma 9
  Uniprot ID: O00512
  ENST ID: ENST00000234739
  CDS Start-End: 741-5021
cttccatgtgtgaaagctacttggcatgaatgcctgggccgtaccaagtgtcaccgcagcaagagggggagtcagaagaaaaacagatcagaccagagcagacaataggcccctaaagtgttccccctaagttgctttgatgttgtcctggtgtcttgataccaggaggccagggattgcgggaaaagggtcttttttgtcttcattcactttcccccctcagtttctgaaatgattctccagaatttctcctcataaaaaaggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagcaggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaagatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttacaaaa

SEQ ID NO: 110926 - DNA, 6272 bp, Homo sapiens
  Payload ID: 1761
  Gene Symbol: BCL9
  Gene Name: B-cell CLL/lymphoma 9
  ENST ID: ENST00000622552
  CDS Start-End: 741-4925
cttccatgtgtgaaagctacttggcatgaatgcctgggccgtaccaagtgtcaccgcagcaagagggggagtcagaagaaaaacagatcagaccagagcagacaataggcccctaaagtgttccccctaagttgctttgatgttgtcctggtgtcttgataccaggaggccagggattgcgggaaaagggtcttttttgtcttcattcactttcccccctcagtttctgaaatgattctccagaatttctcctcataaaaaaggactgaatgtgggcccagttggcgtcattctgctttgacctaaacattcccatctgattgggtggcagagatcatttttggaaagttcttccgtgtcccgatgtagaagaaatagcaaattggacatattgaaagacaagggtcatctttgagaagggggttcctggactcctcacctccaggatgagcactgcagtgtcgtgacccttggggttttgtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataaagctgcagaagctgttttgaagggccaggttgaaactatcgtctctttccacatccagaacatttctaacaacaagacagagagaagcacagcgcctctgaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagcaggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggacccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaagatgagattccaggtcctgagagctgctttgagggagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattttggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttctta

SEQ ID NO: 110927 - DNA, 10005 bp, Homo sapiens
  Payload ID: 1762
  Gene Symbol: BCL9L
  Gene Name: B-cell CLL/lymphoma 9-like
  Uniprot ID: Q86UU0
  ENST ID: ENST00000334801
  CDS Start-End: 966-5465
cgtgcgtgtcttgtctccctgtccacgtgtgagctgtgagtgtgtgtgagtcagagttcgggtgtctgtgggtctctgagcctctgctggcagcacccggggctcgccaagctcttgccggctggcgcgcgcccagcccctggcgggacttgtccgtgtgtctgtccgcgcgcggggcctggagaagcacgctgcagtcctgtccgcctcccgctcgctgcctcgctggctgtcgctcgctcgctctgcctctccgcccgggctctgccgaagggggcggggtgggggtgcagggcggggggaggggaggctcctgcattcttgcggtcggggaggaatccgagccagcgttactggtctccagaagagcccagctgcagccccggggccccgccaggcctctcgctgcccgcccgggcctgctgggatgggcacgggctaggcctcgagctggggacggggcggggcgtggccccaaccccgggccccctccacggctggagcgctctgggggtggggcacgaggggtaccccaccctgggtgaggggcgcgtctgggagcaggaatccctcagggggccaggggagacctcacagccgccccacacggcacctttgctacctagccttttagtgaattctgtctctgccgcccgtcggggcggaggcttgctggagactgcaagccccctgagggcaaggtgcgggagggatggggacagggctggcctccaggatcgagaccccatctcgtaatcctctttttccagtgccaccccaccctatccagctccctagtcccagggctgttgggtcctcccttctcccctccccctctgacaccccctccccaagtcacgagttttctctttggggcttgttgctgcagtccgtgctccagtaccgagtacctggctgggccctgggcacgcacaggggccgtagccccactgtgtgtgggagccatgaggatcctggctaacaagacaaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtggggacgaatggtgctctggaccggacagtgaggaggacgacaagcccattggggccacccacaattgtaatgtagcagacccagccatggcggccccacagctgggtcccggccaaaccacccaactgcccctcagcgagagcagcgtgccaggcgccccgcacggccctcctcctggccttcggcctgatgcccctgggggcgggggcgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggcccctaaagtgccccccaccccagaaccgctacccctgagcacgccgtcagcaggcaccccgcagtcccagccacctccactgccgccgccgccacccccggcccctggcagtgccccgcctgctctgcccccagaggggcctcctgaggacagcagtcaggacctggcccccaactcggtgggagctgccagcacaggtggtgggactgggggcacccaccctaacaccccgacggctaccaccgccaacaaccctctgcctcctggaggagaccccagcagtgcccccggccctgccctgctgggggaggcagccgcccctggaaatgggcagcgcagcctggtgggctcagagggcttgtccaaagagcagctggagcatcgggaacggtccctccagacgctgcgagacattgagcgactgctgctccgcagcggagagactgagcccttcctcaaggggcccccaggaggagcgggtgaggggggcccaccagcacaagccccccctcccccccagcagccacccacggcccctcccagcgggctgaagaaatatgaggaacccttgcagtccatgatttcacagacacagagcctagggggccccccgctggagcatgaagtgcctgggcaccccccgggtggggacatggggcagcagatgaacatgatgatacagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctggaatgggtgcgcagctgcgggggcccatggatgttcaagatcccatgcagctccggggcggacctccctttcctgggccccgtttcccaggcaaccagatacaacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccaccaccgcagggctccgggccagggatcagcaacagccagcccagccagatgcacctgaactcagccgctgcccagagccctatgggcatgaacctgccaggccagcagcccctgtcccatgagcccccgcccgccatgctgccctcccccacccctctgggctccaacattccactgcatcccaacgcacaggggacaggggggccccctcaaaactccatgatgatggccccagggggccccgactccctgaatgccccctgtggcccagtgcccagctcctcccagatgatgcccttcccccctcggctgcagcagccccatggtgccatggcccccactgggggtgggggcggggggcctggcctgcagcagcactacccgtcaggcatggccctgcctcccgaggacctgcccaaccagccgccaggccccatgcctccccagcagcacctgatgggcaaagccatggctgggcgcatgggcgacgcatacccaccgggtgtgctccctggggtggcatcagtgctgaacgaccccgagctgagcgaggtgatccggcccaccccaacggggatccccgagttcgacttgtcgaggatcatcccctctgagaagccaagcagcaccctccagtacttccccaagagcgagaaccagccccccaaggctcagccccctaatctgcatctcatgaacctgcagaacatgatggcggagcagactccctctcggcctcccaacctcccaggccagcagggcgtccagcgggggctcaacatgtccatgtgccaccctggacagatgtccttgctgggcaggacaggcgtgcccccacagcaggggatggtgccccatggcctgcaccagggggtcatgtcccctccacaaggcctcatgacccagcagaatttcatgctgatgaagcagcggggcgtggggggcgaggtctacagccagccgccccacatgctctccccgcagggctccctcatgggccccccgccccagcagaacctcatggtgtcccacccccttcggcagcgcagtgtgtccctggacagccagatgggctacctcccggcaccaggcggcatggccaacctgcccttctagaagtcgctgccagggctggagccggggcaatgttgcaaatacgataaccttaacaaagttcttcccctcaatgttgggatggcctgggtcgcggggtggggtggagggggtgggagggggcttgtgtagggagtggcatttgtggaaaccagatgtgctggcagcttagggggaagtggcagtgtggggtgggggattttgcattggggttggttccatttcggccaccaggactgcccctcccccactcctcccaattcctatggagcctctctattttacctctttccgtgcatccctgcacccgccacacccccttcagctatgcttttggagtcctggatgggaatctggggggagagaggaaggacaggtcaggtctcccccagccccttctgctcctgtctcctcgtgtccgcattgctggagctccacctccctcttggtttctccgcacccgcccattttccttctgtctttacctgcttcgtatcctttccctgctgatgtggctgacccctctcccacccctccctgcaggcggctggccaggtgggcaggtgccagccggagctgtaaatagagcgctgcgcttttgtgctggtttgtgcgtgtgctgtatttctgtgttttgatagaagtcacacaaaaaaaaaaggataaaagaaacccttccccccttcttcaagttattgctccctccattcccctggacccagggacatgcagccctacatggccacccactgtttgcagtgtctctgggtccctaagggataccattcctgtctcgtccccaaatggtaagatgacgtaaatgacccactcctaaactgaggtcagaccacctaggcttccacctggtgagccctagcagggctgagacccccagggcggcagcctgtctgctgctgagtgattcagggagaacatgtgtgcacgtgcatgtgtgtttgcccacaccggtgacacggggccctggctttccactttggatgcccgggcatccgctgctgctacatcttagccagaacttgaagtcttttgtcccagtttgggatgaaggaaaggaggaagaggcggtggctgtgtggcccccttgagtggagccatggaaggggtggcatggtgccactggggcctgtggctgtagtagccctgggccaggtaacctccagggccctgacttttccagaggctgctgccacctacttcttatcaaagaagggggagaacagttcatctgagtcagtgcacctcccctccagtctccactccctgaggatggaatcggggaaacagcatcctgccgcctcctctctgcctgcccactcaccggcaaggttgtccctctgcccagggctcagggccatgtaccagatctgtctgtgcccacccaggcacagccactgcctcccccttggctccctgctcctacccaggagagctccctatccgcctttggtcagagctgaagccatatacgactgggtgtttgtccccctactttggccccaggagtaaaaaaacttctccttttctcacttcctttcctgcctcgggaggtggcagggcagttccctggctgaggccttttgcgccccacctccaggaccaagggccattctagacagggtgtcttctaccaggacccgtccctagccttcctggcctggagggcctggtcttgcactggcagctgtaatacaaagggaactcgccccacttctcccagcctggtgctgtcctctcggcccaccatcggccaggtccagcgcttcctctggggctgacaacaggcccctgactcaccccggtcacctcccagggtccatggccagggcctctgtgtttggggggccacttgcccttcatcctgccaggcgctttgcccgccctgcctcagcctgggccctgtgcccttgagccctccacccctggcccaagacccccccaaactgtctgactctgtgtttcctgccctgaggagagaggggtcagattgcagcgggccgagtgccctctccgtcccctctcctcccacccacgccacaggccagcctactcttccctccatccatggccacacccccagccattttgtaccattatataaatatatatataaatataaatatataaatacaatatgtgaagacatcttcttggtttttattttgaaacaatttttaggcttgttccgggggtctctgtgctgcctgtactgtattgacctgttttataggtgcctttttattaaaaagaaaattcaaaatccagcctcttgcctctttgcatctgcttcagactcccccatcgattacccagcttgcgaggagatactcagagaaaaaagggacgtcttagggcttcctcgttgtcctgccgtgaagacactctcacgtgagccacagctgttatttccccagtggggcctcccaaggagcttggctgcttggcttgagtgggacaagggcaggggtccctgactccccacctgatcaaaggctggggaggtggtagggagcacccagaactgccggacgggcctcccacaccccaggtgagcaaacaagcacggagcagcttcctgcggttccatctgagtgacatcctcacgggggcagggcacggcttcctggggcctggggacttccctgcctcagtgtgtttcttacacttccctgcctaaggtgatgccacggaggggatggttgagatgactcccacgggccccttccagtccacctttctccgttccgactctgagtttcctcgggtctatagcttatgggaagggagtgaggaggggacaagccagcctccttccccatcaatgcccacaacctcccatcccctggacccagccaccctaggagttctccaccccaccccatctcgcctggcggaggggaccgccgggtttgattgatccatctccctccttggggttcgggaagaaagctcttttcttccctctgtcgggtttctttcttgcttctcggccttcacgcttcctcaggtcactggctggcctccaagggcacctagagtcagccctgcctgcagaccacccaggatccggtgacatggggtggacccagcgctgtttcggtcagagccaggggcagctacctgaactcaaccagtctgagcttcctgcttggtcaagatgactgcaggcttgggggcctggcagaatgtctgtgtttttagggactgagttgtccgaaggccacactctgctgccagctggcctttcctcagccttaacctccactcatcccctggtgctcagcttctggctttgtttgacaggtgggcaggaggagagaggggaagctgtggaggtcagcagcccctaagctgatggagtgtgttctgggaggggcaggcgctctccgttggcaagggcagaagtagaagttgtttcttgagcattggatgattaggatgggaggtgcgtgaggttctctcagcccaggggggtgcagatgggtaaggacagccttcactgtgcctttgagctgctttccgctccctgggctccagcctagccccagggccggcagaagagctggcagggatgttctagaaatgggggttggttcctctagctaccccaaatgaggatactcctaggacactcttagccacggtgagcccttaggatcccagctcctgttggaaggagcatccagcatcactgcctgccccaaggaaaagcagcaataaaaggggacactgggacctagaacgtggtgagagaggtggcattctctgactcagagagactgctcctgcgccagctagggaagagctggcacagggaggcagggccggtacagcccagcttcgtcaggagccgcgacaggtcactgcggaacttcacgccggcgaaagtgtagagcatggggttgaggcagcagtgggccaggcccaggaactcacacatggtgatggccacggggagagagccattcagcttgcaggtattgtccacggccttcagcctcgccagggtgtccaggaagatgacgatgtggtagggtgaccagcagaggaagaagatgcttgtcaccaggatggccaccctgactgccttctgccgctgagggcgccgctgggcctggcgcaacctgtgcactacccccacgtagcaccagcccatcaccagcatgggcagcaggaatcccgccacatggtagaggaatcgggaggtgaaccaggcatgcgtttctgcttggttctcttgggagaaggtgcaacgtggcagggagttgttgtgatggccttggctgactttggcgaagagaatctctggcaaggcaaggaggaagcccaccagccagatggtcccacaggtgatgtggatggagaggaggcggcggtggcggtaggcatggacggcgtggacaatggccaggtagcggtccacggcgatgcaggccaggagcaggctgctgcagtagaagttgactttgtgcagggcaatcacagttttgcagaggaaggtccccaggacccagcccacagagcc

SEQ ID NO: 110928 - DNA, 611 bp, Homo sapiens
  Payload ID: 1762
  Gene Symbol: BCL9L
  Gene Name: B-cell CLL/lymphoma 9-like
  ENST ID: ENST00000532899
  CDS Start-End: 347-611
ggaggcaggaacccaggcacccagcgatccccggatagcctctcccgggccgggctggtattgagatcaaggcgtccaggatcaaaagatcaccgcctgcccgccccctctgcatctccaactggcgagcaggaggacccccatccacacaacgaccctgacctggtcatggcgtccagctccggcctggcgtgaggaccccccaatccgcgtgagggagcccccaacccagaccacacccttgagcctgagcccgacattattcctgagtccgtgctccagtaccgagtacctggctgggccctgggcacgcacaggggccgtagccccactgtgtgtgggagccatgaggatcctggctaacaagacaaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgc

SEQ ID NO: 110929 - DNA, 5514 bp, Homo sapiens
  Payload ID: 1762
  Gene Symbol: BCL9L
  Gene Name: B-cell CLL/lymphoma 9-like
  ENST ID: ENST00000526143
  CDS Start-End: 457-4845
gaaggaagcaagcaagcaagcaagggaaggaggagcaggagcaggagccggagccctgaggttcggggccgagaccccggccccgcgccccggccccggcgggtgtgcgcgctctcccgccactgcccggcgcccgcgaccatgctccgcggttgggaggcaggaacccaggcacccagcgatccccggatagcctctcccgggccgggctggtattgagatcaaggcgtccaggatcaaaagatcaccgcctgcccgccccctctgcatctccaactggcgagcaggaggacccccatccacacaacgaccctgacctggtcatggcgtccagctccggcctggcgtgaggaccccccaatccgcgtgaggttaccccaccccaggaggagagaagctccagggagcccgccgctgtccccccgcggtcattgcccccctgccccagccaagccaatgcacccagaaaataaattgaccaatcatggcaagacagggaatggcggggcccaatctcagcaccagaatgtgaaccaaggacccacctgcaacgtgggctcgaagggcgtgggggcggggaaccatggggccaaggccaaccagatctcgcctagcaactcaagtctgaagaacccccaggcaggggtgccccctttcagctcgctcaagggcaaggtgaagagggaccggagtgtgtctgtggactctggagagcagcgagaggctgggaccccatccctggattcagaggccaaagaggtggcgccgcggagtaagcggcgctgtgtgctggagcggaagcagccgtacagtggggacgaatggtgctctggaccggacagtgaggaggacgacaagcccattggggccacccacaattgtaatgtagcagacccagccatggcggccccacagctgggtcccggccaaaccacccaactgcccctcagcgagagcagcgtgccaggcgccccgcacggccctcctcctggccttcggcctgatgcccctgggggcgggggcgggggcgggggcgtccccggaaagcctccctcgcagttcgtatatgtcttcaccacccacctggccaacacggctgcagaggcagtgctgcagggccgggccgactccatcctcgcctaccaccagcagaacgtgccccgggccaagcttgaccaggcccctaaagtgccccccaccccagaaccgctacccctgagcacgccgtcagcaggcaccccgcagtcccagccacctccactgccgccgccgccacccccggcccctggcagtgccccgcctgctctgcccccagaggggcctcctgaggacagcagtcaggacctggcccccaactcggtgggagctgccagcacaggtggtgggactgggggcacccaccctaacaccccgacggctaccaccgccaacaaccctctgcctcctggaggagaccccagcagtgcccccggccctgccctgctgggggaggcagccgcccctggaaatgggcagcgcagcctggtgggctcagagggcttgtccaaagagcagctggagcatcgggaacggtccctccagacgctgcgagacattgagcgactgctgctccgcagcggagagactgagcccttcctcaaggggcccccaggaggagcgggtgaggggggcccaccagcacaagccccccctcccccccagcagccacccacggcccctcccagcgggctgaagaaatatgaggaacccttgcagtccatgatttcacagacacagagcctagggggccccccgctggagcatgaagtgcctgggcaccccccgggtggggacatggggcagcagatgaacatgatgatacagaggctgggccaggacagcctcacgcctgagcaggtggcctggcgcaagctgcaggaggagtactacgaagagaaacggcggaaagaggaacagattgggctgcatgggagccgtcctctgcaggacatgatgggcatggggggcatgatggtgagggggcccccgcctccttaccacagcaagcctggggatcagtggccacctggaatgggtgcgcagctgcgggggcccatggatgttcaagatcccatgcagctccggggcggacctccctttcctgggccccgtttcccaggcaaccagatacaacgggtacctgggtttgggggcatgcagagtatgcccatggaggtgcccatgaatgccatgcagaggcccgtgagaccaggcatgggctggaccgaagacttgccccctatggggggacccagcaattttgcccagaacaccatgccctacccaggtgggcagggtgaggcggagcgattcatgactccccgggtccgtgaggagctgctgcggcaccagctgctggagaagcggtcgatgggcatgcagcgccccctgggcatggcaggcagtggcatgggacagagcatggagatggagcggatgatgcaggcgcaccgacagatggatcctgccatgtttcccgggcagatggctggtggtgagggcctggcgggcactcccatgggcatggagtttggtggaggccggggcctcctgagccctcccatggggcagtctgggctgagggaggtggacccacccatggggccaggcaacctcaacatgaacatgaatgtcaacatgaacatgaacatgaacctgaacgtgcagatgaccccgcagcagcagatgctgatgtcgcagaagatgcggggccctggggacttgatggggccccagggcctcagtcctgaggagatggcccgggttcgggcccagaacagcagtggcgtgatgggcggcccgcagaagatgctgatgccttcacagtttcccaaccagggccagcagggattctctggaggccagggaccctaccaagccatgtcccaggacatgggcaatacccaagacatgttcagccctgatcagagctcaatgcccatgagcaacgtgggcaccacccggctcagccacatgcctctgccccctgcgtccaatcctcctgggaccgtgcattcagccccaaaccgggggctaggcaggcggccttcggacctcaccatcagtattaatcagatgggctcaccgggcatggggcacttgaagtcgcccacccttagccaggtgcactcacccctggtcacctcgccctctgccaacctcaagtcaccccagactccctcacagatggtgcccttgccttctgccaacccgccaggacctctcaagtcgccccaggtcctcggctcctccctcagtgtccgttcacccactggctcgcccagcaggctcaagtctccttccatggcggtgccttctccaggctgggttgcctcacctaagacggccatgcccagcccgggggtctcccagaacaagcagccgcctctcaacatgaactcttccaccaccctgagcaacatggaacagggtaccctcccgcctagcggcccccggagcagctcctcagcacctcccgccaaccctcccagcggcctcatgaaccccagcctaccattcacttcctccccagaccccacaccttcccagaaccccctgtcactgatgatgacccagatgtccaagtacgccatgcccagctccaccccgctctaccacaatgccatcaagaccatcgccacctcagacgacgagctgctgcccgaccggcccctgctgccccccccaccaccaccgcagggctccgggccagggatcagcaacagccagcccagccagatgcacctgaactcagccgctgcccagagccctatgggcatgaacctgccaggccagcagcccctgtcccatgagcccccgcccgccatgctgccctcccccacccctctgggctccaacattccactgcatcccaacgcacaggggacaggggggccccctcaaaactccatgatgatggccccagggggccccgactccctgaatgccccctgtggcccagtgcccagctcctcccagatgatgcccttcccccctcggctgcagcagccccatggtgccatggcccccactgggggtgggggcggggggcctggcctgcagcagcactacccgtcaggcatggccctgcctcccgaggacctgcccaaccagccgccaggccccatgcctccccagcagcacctgatgggcaaagccatggctgggcgcatgggcgacgcatacccaccgggtgtgctccctggggtggcatcagtgctgaacgaccccgagctgagcgaggtgatccggcccaccccaacggggatccccgagttcgacttgtcgaggatcatcccctctgagaagccaagcagcaccctccagtacttccccaagagcgagaaccagccccccaaggctcagccccctaatctgcatctcatgaacctgcagaacatgatggcggagcagactccctctcggcctcccaacctcccaggccagcagggcgtccagcgggggctcaacatgtccatgtgccaccctggacagatgtccttgctgggcaggacaggcgtgcccccacagcaggggatggtgccccatggcctgcaccagggggtcatgtcccctccacaaggcctcatgacccagcagaatttcatgctgatgaagcagcggggcgtggggggcgaggtctacagccagccgccccacatgctctccccgcagggctccctcatgggccccccgccccagcagaacctcatggtgtcccacccccttcggcagcgcagtgtgtccctggacagccagatgggctacctcccggcaccaggcggcatggccaacctgcccttctagaagtcgctgccagggctggagccggggcaatgttgcaaatacgataaccttaacaaagttcttcccctcaatgttgggatggcctgggtcgcggggtggggtggagggggtgggagggggcttgtgtagggagtggcatttgtggaaaccagatgtgctggcagcttagggggaagtggcagtgtggggtgggggattttgcattggggttggttccatttcggccaccaggactgcccctcccccactcctcccaattcctatggagcctctctattttacctctttccgtgcatccctgcacccgccacacccccttcagctatgcttttggagtcctggatgggaatctggggggagagaggaaggacaggtcaggtctcccccagccccttctgctcctgtctcctcgtgtccgcattgctggagctccacctccctcttggtttctccgcacccgcccattttccttctgtctttacctgcttcgtatcctttccctgctgatgtggctgacccctctcccacccctccctgcaggcggctggccaggtgggcaggtgccagccggagctgtaaatagagcgctgcgcttttgtgctggtttgtgcgtgtgctgtatttctgtgttttgatagaagtcacacaaaaaaaaaaggataaaagaaa

SEQ ID NO: 110930 - DNA, 1784 bp, Homo sapiens
  Payload ID: 1763
  Gene Symbol: BLNK
  Gene Name: B-cell linker
  Uniprot ID: Q8WV28
  ENST ID: ENST00000224337
  CDS Start-End: 143-1513
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 110931 - DNA, 1715 bp, Homo sapiens
  Payload ID: 1763
  Gene Symbol: BLNK
  Gene Name: B-cell linker
  Uniprot ID: Q8WV28
  ENST ID: ENST00000371176
  CDS Start-End: 143-1444
gcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaaggatggatcatttcttattcggaaaagctctggccatgattccaaacaaccatatacactagttgtattctttaataagcgagtatataatattcctgtgcgatttattgaagcaacaaaacaatatgccttgggcagaaagaaaaatggtgaagagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaa

SEQ ID NO: 110932 - DNA, 1284 bp, Homo sapiens
  Payload ID: 1763
  Gene Symbol: BLNK
  Gene Name: B-cell linker
  ENST ID: ENST00000427367
  CDS Start-End: 119-1018
acttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 110933 - DNA, 1599 bp, Homo sapiens
  Payload ID: 1763
  Gene Symbol: BLNK
  Gene Name: B-cell linker
  Uniprot ID: Q8WV28
  ENST ID: ENST00000413476
  CDS Start-End: 119-1333
acttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatatagacaatcgatcaagccagaggcattccccacccttcagcaagacacttcccagtaagcccagctggccttcagagaaagcaaggctcacctccaccctgccggccctgactgctttgcagaaacctcaagtcccacccaaacccaaaggcctccttgaggatgaggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaaacaaatccaccaaaaacccatacctctgccaagatttacagaagggggaaacccaactgtggatgggcccctacccagcttttcatctaattccactatttcagaacaggaagctggcgttctctgcaagccatggtatgctggagcctgtgatcgaaagtctgctgaagaggcattgcacagatcaaacaagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttattttt

SEQ ID NO: 110934 - DNA, 440 bp, Homo sapiens
  Payload ID: 1763
  Gene Symbol: BLNK
  Gene Name: B-cell linker
  ENST ID: ENST00000495266
  CDS Start-End: 1-198
atggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagacacctgctccctttcctggaacccttccaaatagtcttgatgtcagaacatttaatctctcctggaatgcagaagtgtggcccaacaggatcttctaagcctttgcaacacaaagtttgattcccagcaagatagcatcaacctcatctggagcttgttagaaatgcagaatcttggccccaccctagaactactggatcagaatttacattttagcaagatctccaggggatctgaatgtaaatcatatttaagaaaccctgctataaaccacca

SEQ ID NO: 110935 - DNA, 927 bp, Homo sapiens
  Payload ID: 1763
  Gene Symbol: BLNK
  Gene Name: B-cell linker
  ENST ID: ENST00000467799
  CDS Start-End: 190-555
tgtgctcgggcaagttttacttctccctagagcaggggtgtttgccagcagcctgcactctcagaaatcagacttgagtggccggaacccttgagaccagaggcttaccatgctgctccctaggagggccaggaactgctgacgtgaccactggacagttattcgtgtctcttacaattaccaaacagaatggacaagcttaataaaataaccgtccccgccagtcagaagttgaggcagcttcaaaagatggtccatgatattaaaaacaatgaaggtggaataatgaataaaatcaaaaagctaaaagtcaaagcacctccaagtgttcctcgaagggactacgcttcagagagccctgctgacgaagaggagcagtggtccgatgactttgacagcgactatgaaaatccagatgagcactcggactcagagatgtacgtgatgcccgccgaggagaacgctgatgacagctacgagccgcctccagtagagcaggaaaccaggccggttcacccagccctgcccttcgccagaggcgagtatataggctgattatgtggtccccgtggaagataatgatgaaaactatattcatcccacagaaagcagttcacctccacctgaaaaagctcccatggtgaatagatcaaccaagccaaattcctcaacgcccgcctctcctccaggaacagcttcaggtcgaaacagtggggcctgggaaaccaagtcacctccaccagctgcaccatccccgttgccacgggccgggaaaaaaccaacgacaccactgaagacaactccagttgcctctcaacagaatgcttcaagtgtttgtgaagaaaaacctatacctgctgaacgccaccgagggtcaagtcacagacaagaagctgtgcagtcaccagtgtttcctcctgcccagaa

SEQ ID NO: 110936 - DNA, 4572 bp, Homo sapiens
  Payload ID: 1764
  Gene Symbol: BCAP29
  Gene Name: B-cell receptor-associated protein 29
  Uniprot ID: Q9UHQ4
  ENST ID: ENST00000005259
  CDS Start-End: 340-1065
agacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagcta

SEQ ID NO: 110937 - DNA, 1946 bp, Homo sapiens
  Payload ID: 1764
  Gene Symbol: BCAP29
  Gene Name: B-cell receptor-associated protein 29
  Uniprot ID: Q9UHQ4
  ENST ID: ENST00000379117
  CDS Start-End: 138-863
gagcgggagggccgggaagccgggcgttggtggagggaggcgttgggcttctgtcgccgcgaagctggcggaaaaggcagtggccagcgagccgcctcgccagttcccacgactcccagggaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaa

SEQ ID NO: 110938 - DNA, 5773 bp, Homo sapiens
  Payload ID: 1764
  Gene Symbol: BCAP29
  Gene Name: B-cell receptor-associated protein 29
  Uniprot ID: Q9UHQ4
  ENST ID: ENST00000379119
  CDS Start-End: 15-1061
gtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagcattccagttttggtgaatttttaagcaaaagaagccacaaaaatggcagcattggaaaacagactggttctagaaaaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtaccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtc

SEQ ID NO: 110939 - DNA, 812 bp, Homo sapiens
  Payload ID: 1764
  Gene Symbol: BCAP29
  Gene Name: B-cell receptor-associated protein 29
  ENST ID: ENST00000442065
  CDS Start-End: 51-566
cggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggtttctgttagcaaaagtacattgtagaaaactataaaattctgaaaaggacaaagaataaattataaacagattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagg

SEQ ID NO: 110940 - DNA, 474 bp, Homo sapiens
  Payload ID: 1764
  Gene Symbol: BCAP29
  Gene Name: B-cell receptor-associated protein 29
  ENST ID: ENST00000421217
  CDS Start-End: 76-474
gggcttctgcgacccggggacccgtggggcgtaggccgcggagggagagcgccgctgcctggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaac

SEQ ID NO: 110941 - DNA, 1157 bp, Homo sapiens
  Payload ID: 1764
  Gene Symbol: BCAP29
  Gene Name: B-cell receptor-associated protein 29
  Uniprot ID: Q9UHQ4
  ENST ID: ENST00000445771
  CDS Start-End: 52-1098
gcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagcattccagttttggtgaatttttaagcaaaagaagccacaaaaatggcagcattggaaaacagactggttctagaaaaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggt

SEQ ID NO: 110942 - DNA, 998 bp, Homo sapiens
  Payload ID: 1764
  Gene Symbol: BCAP29
  Gene Name: B-cell receptor-associated protein 29
  ENST ID: ENST00000457837
  CDS Start-End: 309-998
gagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcag

SEQ ID NO: 110943 - DNA, 1059 bp, Homo sapiens
  Payload ID: 1764
  Gene Symbol: BCAP29
  Gene Name: B-cell receptor-associated protein 29
  ENST ID: ENST00000436699
  CDS Start-End: 1-490
tgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattg

SEQ ID NO: 110944 - DNA, 746 bp, Homo sapiens
  Payload ID: 1764
  Gene Symbol: BCAP29
  Gene Name: B-cell receptor-associated protein 29
  ENST ID: ENST00000479917
  CDS Start-End: 158-746
agcgcagggagccaggcgggctgccggcgggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatg

SEQ ID NO: 110945 - DNA, 942 bp, Homo sapiens
  Payload ID: 1764
  Gene Symbol: BCAP29
  Gene Name: B-cell receptor-associated protein 29
  ENST ID: ENST00000465919
  CDS Start-End: 247-690
gtcccgcgcgtcggcggccgcggagcagcgcagggagccaggcgggctgccggcggatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcatt

SEQ ID NO: 110946 - DNA, 885 bp, Homo sapiens
  Payload ID: 1764
  Gene Symbol: BCAP29
  Gene Name: B-cell receptor-associated protein 29
  ENST ID: ENST00000491150
  CDS Start-End: 1-885
attgcaactttttggaacaaggctttccttaccattatcatcctattgattgttctatttctagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactga

SEQ ID NO: 110947 - DNA, 498 bp, Homo sapiens
  Payload ID: 1764
  Gene Symbol: BCAP29
  Gene Name: B-cell receptor-associated protein 29
  ENST ID: ENST00000473124
  CDS Start-End: 306-498
gggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctag

SEQ ID NO: 110948 - DNA, 943 bp, Homo sapiens
  Payload ID: 1764
  Gene Symbol: BCAP29
  Gene Name: B-cell receptor-associated protein 29
  ENST ID: ENST00000482371
  CDS Start-End: 56-256
ggccgcggagcagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaaggattttgaaaagccatggtaaagatgaagaatgtgttttggaagcagaaaataaaaaactagtagaagaccaggagaaactgaaaactgaattaaggaagacttcagatgccctttctaaggcacaaaatgatgtgatggaaatgaagatgcagtcagagagactttcgaaagaatatgatcaactcctgaaagaacactctgaacttcaggtttttgctaaactacttaactacctccttatgaggaagtggtgagccagcctccaactcctcccccagcatacagtgacttccagctacgcagcagcagcagctcctgcctccacagtgaggcctggcagatggcagtcccccagcgccaatcccaccaggggatccaagggaatcccttgtctgagcccagcagaagcatcacaagacccccaagcatcgctgatcctgagccctctgacctaccaggtgaccgagtagccaccaaagccctggggatgcagcccagtggctctgtagccagcctgggagagctggacccaggggccttcctggacaaggaggcaga

SEQ ID NO: 110949 - DNA, 1589 bp, Homo sapiens
  Payload ID: 1765
  Gene Symbol: BCAP31
  Gene Name: B-cell receptor-associated protein 31
  Uniprot ID: P51572
  ENST ID: ENST00000345046
  CDS Start-End: 409-1149
tctcgcccctcggcggggcccctcccgcaccacagagacgtgggacggccgcgcggactagagaagcggccctcgccggcccgacaaagccccgccccgccccgcccgcgtgctcgctccaccccgccctgctcgcccggagcccgaggcgcctcttcctctcccgctcggagcgccggccctccgctccggggcggggtgggaagcggaggtgggcggagcctccggggcctcgcgagggctggtgggcggtgcccggcgggcgcttccggtttccggccgcggtatgaggggcggggccggggctgctgtgggagagttctgttgctgcggcggggcctgcacgttgactgtgggaaactcggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtgta

SEQ ID NO: 110950 - DNA, 669 bp, Homo sapiens
  Payload ID: 1765
  Gene Symbol: BCAP31
  Gene Name: B-cell receptor-associated protein 31
  ENST ID: ENST00000423827
  CDS Start-End: 135-669
ggtgggcgctggggcccgcgagggctactgtaaggacccctggcttctgaggatactgcgtctagaactttctccgtatggggccttgaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggagg

SEQ ID NO: 110951 - DNA, 1810 bp, Homo sapiens
  Payload ID: 1765
  Gene Symbol: BCAP31
  Gene Name: B-cell receptor-associated protein 31
  Uniprot ID: P51572
  ENST ID: ENST00000458587
  CDS Start-End: 431-1372
ctccgggacggtgtgccaggccggggccaagtcggaggcccctcgctctgggtgggcgctggggcccgcgagggctactgtaaggacccctggcttctgaggatactgcgtctagaactttctccgtatggggccttgaggtgcttggtcgagacctgcctttgcgcttggtcccgaatcctgccctctaggagtcgctcttgcgggcctccagcccaccggaggcgaagcggccccgggcggaaggccgctggatcctcgagggaggtgccggtttctctccgcgggcgccgtggggacggtgggaggcgggggcgtcggcagcgcttggactaggtgcggccttgggcctgcctggtagcggggatttgggcccgcagagcgcccgcctctgcggctgagttctgcctggcggggaagggagcgcccgatgggtgccgaggcgtcctcctcttggtgccctggcactgctcttcccgaagaacgcctttcagttaaacgggcgtcggaaatctcgggcttcctggggcagggatcgtcgggagaggccgctctggacgtgttgacacacgtgctggagggggcaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgcagaagctaaaggacgagctggccagcactaagcaaaaactagagaaagctgaaaaccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttggcttccacgcctgagcgtggagagcacgagttagttgtagtccggcttgcggtggggctgacttcctgttggtttgagcccctttttgttttgccctctgggtgttttctttggtcccgcaggagggtgggtggagcaggtggactggagtttctcttgagggcaataaaagttgtcatggtgtg

SEQ ID NO: 110952 - DNA, 688 bp, Homo sapiens
  Payload ID: 1765
  Gene Symbol: BCAP31
  Gene Name: B-cell receptor-associated protein 31
  ENST ID: ENST00000416815
  CDS Start-End: 143-688
aggagcggccgggatgggcctccgggacggtgtgccaggccggggccaagtcggaggcccctcgctctgggtgggcgctggggcccgcgagggctactgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacagg

SEQ ID NO: 110953 - DNA, 793 bp, Homo sapiens
  Payload ID: 1765
  Gene Symbol: BCAP31
  Gene Name: B-cell receptor-associated protein 31
  ENST ID: ENST00000442093
  CDS Start-End: 228-793
gagagttctgttgctgcggcggggcctgcacgttgactgtgggaaactcggtgagcgggctccgcgcgccgggctgggctccgggaccgcggaggctccccggcccatcgacgagggagagaggcgagcggcgcggggaggcccgggggccggggaatctcggggcccgcagcctacctgcgtgaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgacctgca

SEQ ID NO: 110954 - DNA, 570 bp, Homo sapiens
  Payload ID: 1765
  Gene Symbol: BCAP31
  Gene Name: B-cell receptor-associated protein 31
  ENST ID: ENST00000430088
  CDS Start-End: 156-570
agtgcagggggtcagggtggagagtggcggccccagcctcgcagggtaactgaactggatgttcttggctgcccagcgcttacaagtcccgtaccttttgtgccctgccaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagc

SEQ ID NO: 110955 - DNA, 684 bp, Homo sapiens
  Payload ID: 1765
  Gene Symbol: BCAP31
  Gene Name: B-cell receptor-associated protein 31
  ENST ID: ENST00000429550
  CDS Start-End: 124-684
tcgcccggagcccgaggcgcctcttcctctcccgctcggagcgccggccctccgctccggggcggggtgggaagcggaggaaacaagctcacatcttcctgtgggaaaccttctagcaacaggatgagtctgcagtggactgcagttgccaccttcctctatgcggaggtctttgttgtgttgcttctctgcattcccttcatttctcctaaaagatggcagaagattttcaagtcccggctggtggagttgttagtgtcctatggcaacaccttctttgtggttctcattgtcatccttgtgctgttggtcatcgatgccgtgcgcgaaattcggaagtatgatgatgtgacggaaaaggtgaacctccagaacaatcccggggccatggagcacttccacatgaagcttttccgtgcccagaggaatctctacattgctggcttttccttgctgctgtccttcctgcttagacgcctggtgactctcatttcgcagcaggccacgctgctggcctccaatgaagcctttaaaaagcaggcggagagtgctagtgaggcggccaagaagtacatggaggagaatgaccagctcaagaagggagctgctgttgacggaggcaagttggatgtcgggaatgctgaggtgaagttggaggaagagaacaggagcctgaaggctgac

SEQ ID NO: 110956 - DNA, 3372 bp, Homo sapiens
  Payload ID: 1766
  Gene Symbol: BANK1
  Gene Name: B-cell scaffold protein with ankyrin repeats 1
  Uniprot ID: Q8NDB2
  ENST ID: ENST00000322953
  CDS Start-End: 275-2632
aaaccaaagcggccttttgagaagggatgtaagagcaggcccctgagcagtttcacttcctctgggcgcccagcagagcggagccctggccttgcgggcatgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccaggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagcta

SEQ ID NO: 110957 - DNA, 3141 bp, Homo sapiens
  Payload ID: 1766
  Gene Symbol: BANK1
  Gene Name: B-cell scaffold protein with ankyrin repeats 1
  Uniprot ID: Q8NDB2
  ENST ID: ENST00000444316
  CDS Start-End: 134-2401
ctggccaacaagggctgcagaggatgcacacatcaggaagagggtgggggactacttgcttgctggttttgcttgcatctgatgagtagaaattcagcctattctttgttttggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagcta

SEQ ID NO: 110958 - DNA, 3044 bp, Homo sapiens
  Payload ID: 1766
  Gene Symbol: BANK1
  Gene Name: B-cell scaffold protein with ankyrin repeats 1
  Uniprot ID: Q8NDB2
  ENST ID: ENST00000428908
  CDS Start-End: 275-2233
aaaccaaagcggccttttgagaagggatgtaagagcaggcccctgagcagtttcacttcctctgggcgcccagcagagcggagccctggccttgcgggcatgagccccggggctgcgtttcctgagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatc

SEQ ID NO: 110959 - DNA, 3544 bp, Homo sapiens
  Payload ID: 1766
  Gene Symbol: BANK1
  Gene Name: B-cell scaffold protein with ankyrin repeats 1
  Uniprot ID: Q8NDB2
  ENST ID: ENST00000504592
  CDS Start-End: 419-2731
tttggtttctcttcaagaattaacaaaccacttactcttgaattctcttctagttaacacaggcatcactacttccaattgatctcaggatgtgggatcctcatacacattttgaacaaaatcctctgtttcagcaaggaattcatatttgcatatggtgaagatggtttctgaagtgagatcagaagtagagcttctaatgacccccagaagcactgagtgaccaagtgacatacctgccaggcccattgtgtccatcgctctcagagcagctggggattgtgcttggctcccagagctatggtgcaaaaggcggggtcgctagggccactcagggaaagagaacccagaaacatggcatgctgacaaaaggtagtctctgcttatccagcttcactttctgctgatttagttacccatggtcaactgccatctgaaaataggaaatacaaaagatataataatgatatatgaagaagatgctgaggaatgggctctgtacttgacagaagtatttttacatgttgtgaaaagggaagccatcctgttatatcgcttggagaatttctcttttcggcatttggagttgctgaacttaacgtcttacaaatgtaaacttttgatattatcaaatagcctgcttagagacctaactccaaagaaatgtcagtttctggaaaagatacttcattcaccaaaaagtgtagttactttgctttgtggagtgaagagttcagatcagctctatgaattactaaatatctctcaaagcagatgggagatctcaactgaacaggaacctgaagactacatctctgtaatccagagtatcatattcaaagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaaggttattataatgaaactcacgaatctacggacattttgctttcagggtgaagcaagcttgaatttggattgcctgctctctttaaagcgaattcatactatgacagcagaaacaaaacttcagatttcagaatttgttattggcaaaatttattctcattatacctgcttcatatgggtatattactattaaaacagaataccatagagtaattgcattatttgaaaattctctcattttacaatgcacttcaccaatgaaacagctaatttccattttgaaaattaaaagaaaacagcacagagaagttaaatgcggtgtagcaaagttatggggtctgcttgagggcactaacctcaacagattattcctcctctccttagaataaccatgaaaatacaaatttacttagcacatttttgctttttaagtagctggttcattttctgaatttctcacattcagagttccagtcattattgttacatcatgtttgcagaaaccttgtcttatttagtgtctatttgcatataaccctgaaaacattattatttgaaaacttttctatatctcaaattaatatacattttcataacctacctttgtattaagacttgcaattttatcaatctattatttcttagaaacaatttactagcttagaatagaaagcaatgttatcgtcatataattttcatgtacaaatgccacaaataaattgaatgtttaaagctatgtctgagtttttaaagtaaatttataagaattagccaataaaattgcttctcggccttttggctaagatcaa

SEQ ID NO: 110960 - DNA, 2115 bp, Homo sapiens
  Payload ID: 1766
  Gene Symbol: BANK1
  Gene Name: B-cell scaffold protein with ankyrin repeats 1
  Uniprot ID: Q8NDB2
  ENST ID: ENST00000508653
  CDS Start-End: 152-2110
gagacctggccgcagcctccgcgggtggcaagcgggctggggagagccgagggccaaaggaagagaaaatcgcggggagtctctggccgggagagtccaggtagcgctcggcgggcagcagtgcgcaggcccctcggcttcaaccgccacaatgctgccagcagcgccaggcaaggggcttgggagcccggaccccgccccctgcggcccagcgcccccagattctgaagactactttgaggtcaacattccaacagacctacgagcaaaacattctggggaaataagtgagagaaaggaaattgaagaactatcagaagcttcaagaaacaccataccactagcagtggtgcttcccactgaaattccatgtgagaatcctggtgaaatattcataattttgagagatgaagtaattggtgatactgtagaggttgaatttacatcaagtaataagcgcattagaacacggccagccctttggaataagaaagtctggtgcatgaaagctttagagtttcctgctggttcagtccatgtcaatgtctactgtgatggaatcgttaaagctacaaccaaaattaagtactacccaacagcaaaggcaaaggaatgcctattcagaatggcagattcaggagagagtttgtgccagaatagcattgaagaacttgatggtgtccttacatccatattcaaacatgagataccatattatgagttccagtctcttcaaactgaaatttgttctcaaaacaaatatactcatttcaaagaacttccaactcttctccactgtgcagcaaaatttggcttaaagaacctggctattcatttgcttcaatgttcaggagcaacctgggcatctaagatgaaaaatatggagggttcagaccccgcacatattgctgaaaggcatggtcacaaagaactcaagaaaatcttcgaagacttttcaatccaagaaattgacataaataatgagcaagaaaatgattatgaagaggatattgcctcattttccacatatattccttccacacagaacccagcatttcatcatgaaagcaggaagacatacgggcagagtgcagatggagctgaggcaaatgaaatggaaggggaaggaaaacagaatggatcaggcatggagaccaaacacagcccactagaggttggcagtgagagttctgaagaccagtatgatgacttgtatgtgttcattcctggtgctgatccagaaaataattcacaagagccactcatgagcagcagacctcctctccccccgccgcgacctgtagctaatgccttccaactggaaagacctcacttcaccttaccagggacaatggtggaaggccaaatggaaagaagtcaaaactggggtcatcctggtgttagacaagaaacaggagatgaacccaaaggagaaaaagagaagaaagaagaggaaaaagagcaggaggaggaagaagacccatatacttttgctgagattgatgacagtgaatatgacatgatattggccaatctgagtataaagaaaaaaactgggagtcggtctttcattataaatagacctcctgcccccacaccccgacccacaagtatacctccaaaagaggaaactacaccttacatagctcaagtgtttcaacaaaagacagccagaagacaatctgatgatgacaagttctgtggtcttcctaagaaacaagacagagctcggatagagagtccagccttttctactctcaggggctgtctaactgatggtcaggaagaactcatcctcctgcaggagaaagtaaagaatgggaaaatgtctatggatgaagctctggagaaatttaaacactggcagatgggaaaaagtggcctggaaatgattcagcaggagaaattacgacaactacgagactgcattattgggaaaaggccagaagaagaaaatgtctataataaactcaccattgtgcaccatccaggtggtaaggaaactgcccacaatgaaaataagttttataatgtacacttcagcaataagcttcctgctcgaccccaagttgaaaaggaatttggtttctgttgcaagaaagatcattaaagaag

SEQ ID NO: 110961 - DNA, 4680 bp, Homo sapiens
  Payload ID: 1767
  Gene Symbol: BTG1
  Gene Name: B-cell translocation gene 1, anti-proliferative
  Uniprot ID: P62324
  ENST ID: ENST00000256015
  CDS Start-End: 363-878
acttccttttcgtggcactataaagggtgctgcacggcgcttgcatctcttcgcctctcggagctggaaatgcagctattgagatcttcgaatgctgcggagctggaggcggaggcagctggggaggtccgagcgatgtgaccaggccgccatcgctcgtctcttcctctctcctgccgcctcctgtctcgaaaataacttttttagtctaaagaaagaaagacaaaagtagtcgtccgcccctcacgccctctcttcctctcagccttccgcccggtgaggaagcccggggtggctgctccgccgtcggggccgcgccgccgagccccagccgccccgggccgcccccgcacgccgcccccatgcatcccttctacacccgggccgccaccatgataggcgagatcgccgccgccgtgtccttcatctccaagtttctccgcaccaaggggctcacgagcgagcgacagctgcagaccttcagccagagcctgcaggagctgctggcagaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcccttccaaaaactacaatatgatgactgtatcaggttaagatatagtctgtggatggatcatctgatgatgatggataaatttgatttttgctttgggtgggctcctcttggggatggattatggaatttaaaccatgtcacagctgtgaagatctggcacaagatagaatggtaaaaaaaaaaaaaattttaagtgacagtgccatagtttggacagtacctttcaatgattaattttaatagcctgtgagtccaagtaaatgatcactttatttgctagggagggaagtcctagggtggtttcagtttctcccagacatacctaaatttttacatcaatccttttaaagaaaatctgtatttcaaagaatctttctctgcagtaaatctcgcaggggaatttgcactattacacttgaaagttgttattgttaaccttttcggcagcttttaataggaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccatggcaacaggctttaaaaaagacccttaaaaagacactgtctcaactgtggtgttagcaccagccagctctctgtacatttgctagcttgtagttttctaagactgagtaaacttcttatttttagaaagtggaggtctggtttgtaactttccttgtacttaattgggtaaaagtcttttccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaatcgtttcttatcttggcattttaatcaatctcttgtcatgattatagaggtttagctaaaagtattttttcttagaagacaggttctataaactgaatctctgttgcacactggtcatgctggaaaaacatttgatgaggaatgaagatgctctgtatatacatgtttaggttttacaggaaacacaggagtagcatgttttaaaaatttctaaagtcaaaacatggacacattcacaggctaatgatctcatgaaataaggataagagaccacggtagcatctaccaaaaatgtgatactcaaaggattacatttcattgcttccctgttgaagtgaagatataaatgttccattctgacccacctttgaaaaacaattactttgccccatggattctttgttcaattagaaatttccccggggcaggtgacccatagtcttaaagaacaggctaaacaccacagagagattggttgctttttgcttttcatcacctgcaagatgtacataaaaatcacataagctggaattcaacaaaaggtatgtttatgaacttttattctcaaaagttgaaatgctgactttctcgattcctcattttcagacttttatttcagataaatactaaaaacctaagtgaaccttgataatgctgtagtgtagattacttcactaccccatataatagaaggacttgctgtttagttgtagaggataacagcgtttttcagtggaaattgaaagtggaaaaattgaattttgctctacacagttaacatatagtggcctttttttggtatatatgtaaacatgttgacactggaaatacgcagtctgaaataaaattagtaattacttgaaattagtaatctcaaataacttttaagaagttatttctacacccaggaataaattattctgattttgtagacaacacaggaataggccactgaatatgcaggtatttagagtacaaatgtctgtggatattattggcacaccattctcgagagttagaattcgtagacccgcaacacatggactacccttgccaattgttatggttttatttttaaacctattctgtgaaaaagctcctcggtatttcaaacttgaattacaataaaaacaccaggtagggttgtttttaaatgggtctcaccccagtgctgactactgttgtttaccaactacatttcatctggtaactccattgaaactaagtacctcaaccattttttttttttatcataaagccttttttcaaatggaaagttgtttttgaagatcttgacatcagactttttcaatctttgaaaatgatggaaacagttaataaaaatgtttattttagaattcaggtgatgtctggcttgtgaggagctgtttataagtttgtctttgaaaaaggcttgcacacatcactctgagaccagctgtttcctgtgactttaaccttaccttccccagacaattgagctgaacctgtatctgcggtacagtagctgtttgtgatgtatttcttgttcactgtttctggggaatgttttgaaatattttattataaatccttttaagataggatgactactttcaaaattattgttgcctttggcaccaggaattcatagttgtgattggcagtaagtttgaggagtgttactttctaagttttaacaggtagttttgaaattatttccttttttccaaatttaagtagtgcctccctctgtaatgttgaaacaaggcttcaagtggattgtatagcaagagttaccctggttcatgcaggataatgcggctgttatctttgtcatctggaatgggaatctcatgtctttatccttatgtgcaatatttctataataatagactggaaaggccaccagaaagtggctttcaggtacattgcacaaatagtttccttaagtcattataactcacacattgcaagtaattaattttgttttgtataggtgttgcagtttatgaaattggccttcaagttaaaaggaaggaagccgtattcccgatggctagtgtttaatgactacaggtttccaggctccctttaatcttgggagcaaataaatctactattggacttctccctgcgtgacttttaacatttctgatactctctcttcttcctctttacagaagagaggtatgataactgaagttgtactttgcatattgaagtttaaagatacttcctctccccttttcacccctatttcaaatgatgtgataaaatcctcttgataggctatatggagaacatttgtcaatagttttatctatgcatggaagtcttcaaaaagtatatcttggattgtctaaaactgaatagatttcttatttatctgaaggtatacagactgccaacattttagacttatctctcagtctctgccactgaacttttatatatggctgctatcaaaatataaccggtttattttcatatttggaactaatataacagtatcacaaaatcttttacagtaagatagtttgtaataccagccgacccagctgcttaactgagtccttaaatcatttaatatatgggactgtaaatagagaaatctgtacattatgagatctgatttctggttatgcctatagatctttattttctttatccctatagatcattttcttctgatgttaagtgttatatttttgaaatgctcctaaacaagtaagccttagattgtattaatcctgaggattgataccatttcctcaacactttgtggagtatgattgacaccagtttttttttgactgcaggtttaacttggcttatcacttttcgtattgctcagtatgtccaagataggaataaaaaaatgtagttcaa

SEQ ID NO: 110962 - DNA, 504 bp, Homo sapiens
  Payload ID: 1767
  Gene Symbol: BTG1
  Gene Name: B-cell translocation gene 1, anti-proliferative
  ENST ID: ENST00000552315
  CDS Start-End: 252-504
agcggttccccgcgaggctttaggggctggacggagggcgcccccttccccccagctggcaaaacggagaggagaagacaacacgcacaacaaagaaacttaagcccaccgaggcgggagctgcggtccgaggaccgtcggcggatttggggacaaaggagccgtggggctgggaacattataaacatcactggttcccagaaaagccatgcaagggatcgggttaccgttgtattcgcatcaaccataaaatggatcctctgattggacaggcagcacagcggattggactgagcagtcaggagctgttcaggcttctcccaagtgaactcacactctgggttgacccctatgaagtgtcctacagaattggagaggatggctccatctgtgtgctgtatgaagcctcaccagcaggaggtagcactcaaaacagcaccaacgtgcaaatggtagacagccgaatcagctgtaaggaggaacttctcttgggcagaacgagcc

SEQ ID NO: 110963 - DNA, 1018 bp, Homo sapiens
  Payload ID: 1768
  Gene Symbol: BTG4
  Gene Name: B-cell translocation gene 4
  Uniprot ID: Q9NY30
  ENST ID: ENST00000356018
  CDS Start-End: 201-872
cctgaagggcctccaagggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgccgttagtagagcctcatcagacgtttcctctggcacttcctgcgatgaagaaagttgtagcaaggaacctcgtgtcattcctaaagtcagcaatccgaagagtatttatcaggttgaaaacttgaaacagccctttcaatcttggttacaaatcccccgcaaaaagaatgtggtggacggccgtgttggcctcctgggaaacacttaccatggctcgcagaagcatcctaagtgttacaggcctgctatgcaccggctggacagaattttataacccacatctgggaatgaatttgcagcacctggtagaagaaggcaccttggaaggcactgccttgggcttccatggcaggaagatgagaagaaatcttcagggtgatttctggagcctgaaaagaataaaaaacaaaaccaaaccta

SEQ ID NO: 110964 - DNA, 754 bp, Homo sapiens
  Payload ID: 1768
  Gene Symbol: BTG4
  Gene Name: B-cell translocation gene 4
  ENST ID: ENST00000456861
  CDS Start-End: 273-754
ccaagggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagttgaagtcacgaggagttctccaagaaaggtctgctggctgattcttcattgacctaccagtccctgctatcaaggacactagaacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgccgttagtagagcctcatcagacgtttcctctggcacttcctgcgatgaagaaagttgtagcaaggaacctcgtgtcattcctaa

SEQ ID NO: 110965 - DNA, 1394 bp, Homo sapiens
  Payload ID: 1768
  Gene Symbol: BTG4
  Gene Name: B-cell translocation gene 4
  Uniprot ID: Q9NY30
  ENST ID: ENST00000525791
  CDS Start-End: 186-806
agggagacgcctagaagatggaggcccagattcttgagacgtttctctttctgatctagcaggagggacaaagagctcctccactccctcattccccaagaaggcccccagcctacccagtttccgtgaccattccgccctgggaaagcggcttcccagacctccttatctatttttcttgaatcatgagagatgaaattgcaacaacagttttctttgtcacaagattggtgaaaaaacatgataaactaagtaaacagcaaatagaagactttgcagaaaagctgatgacgatcttgtttgaaacatacagaagtcactggcactctgattgcccttctaaagggcaagccttcaggtgcatcaggataaacaacaatcagaataaagatcccattctagaaagggcatgtgtggaaagtaatgtagatttttctcacctgggacttccgaaggagatgaccatatgggtagatccctttgaagtatgctgtaggtatggtgagaaaaaccatccatttacagttgcttcttttaaaggcagatgggaggaatgggaactatatcaacaaatcagttatgccgttagtagagcctcatcagacgtttcctctggcacttcctgcgatgaagaaagttgtagcaaggaacctcgtgtcattcctaaagtcagcaatccgaagagtatttatcaggtcaagagtgttccagttcttttctatactttttttctatctaattctaaaaagaatgcactcattatgaaaacaaagaagcaaaaaaacatggaaagaacaaaactgtagatttttaaaagccagactcttaatattttggcaaaactttttctgtctccttcactgcacaatgtattccctacacttggctgagcttttaggatccacataatcttttattgtcctatttcttcatacagtatttgaagatacacaggtttccttccacttaaattcctacagaatcaaagattaagattagtgggatttttttttctgtcaattgaaaataccacggcatttatagaaaatttggatataggaaaggtcaaaggcctataaattctgccactagagcagtttttctcagctatttttttcttctttttaaaccataacccattcaaaatatgtatatttacatttaaaaagtttcatgaaacagtgcttatctttactaggagcaatgctcccaatgctcccaatacttccaattaaattcatttgatttcaagtatctaaattgatttcatgacccacaatttgaaaaacactgatctagagagaatttgttaacactatatgtatatatttgtttgtatgttctcttaatcacctatgtattaaatgttaaagcaattaaaattttaatattca

SEQ ID NO: 110966 - DNA, 1347 bp, Homo sapiens
  Payload ID: 1769
  Gene Symbol: BBC3
  Gene Name: BCL2 binding component 3
  Uniprot ID: Q96PG8
  ENST ID: ENST00000300880
  CDS Start-End: 165-470
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtgagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 110967 - DNA, 1538 bp, Homo sapiens
  Payload ID: 1769
  Gene Symbol: BBC3
  Gene Name: BCL2 binding component 3
  Uniprot ID: Q9BXH1
  ENST ID: ENST00000341983
  CDS Start-End: 165-560
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 110968 - DNA, 1838 bp, Homo sapiens
  Payload ID: 1769
  Gene Symbol: BBC3
  Gene Name: BCL2 binding component 3
  Uniprot ID: Q9BXH1
  ENST ID: ENST00000439096
  CDS Start-End: 282-863
gcggcgcgagccacatgcgagcgggcgcctggcggcggcggcggcggcaccagcgatcccagcagcggccacgacgcggacgcgcctgcggcccggggagcagcagcagccacagccacagcagccgccactgcagttagagcggcagcagcagcgacagccacagcagcagccgccgcggagagcggcgctcggcgggcgcgccctcctgaaggaagccgcccgccccccaccgccgccccctccggcgtgttcatgcccccggggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaaca

SEQ ID NO: 110969 - DNA, 1827 bp, Homo sapiens
  Payload ID: 1769
  Gene Symbol: BBC3
  Gene Name: BCL2 binding component 3
  Uniprot ID: Q96PG8
  ENST ID: ENST00000449228
  CDS Start-End: 165-950
gaggcgattgcgattgggtgagacccagtaaggatggaaagtgtagaggagacaggaatccacggctttggaaaaaggaaggacaaaactcaccaaaccagagcagggcaggaagtaacaatgagaaactgaaaaagaaacggaatggaaagctatgagacaggatgaaatttggcatggggtctgcccaggcatgtccatgccaggtgcccagggctgcttccacgacgtgggtcccctgccagatttgtggccccagggagcgccatggcccgcgcacgccaggagggcagctccccggagcccgtagagggcctggcccgcgacggcccgcgccccttcccgctcggccgcctggtgccctcggcagtgtcctgcggcctctgcgagcccggcctggctgccgcccccgccgcccccaccctgctgcccgctgcctacctctgcgcccccaccgccccacccgccgtcaccgccgccctggggggttcccgctggcctgggggtccccgcagccggccccgaggcccgcgcccggacggtcctcagccctcgctctcgctggcggagcagcacctggagtcgcccgtgcccagcgccccgggggctctggcgggcggtcccacccaggcggccccgggagtccgcggggaggaggaacagtgggcccgggagatcggggcccagctgcggcggatggcggacgacctcaacgcacagtacgagcggcggagacaagaggagcagcagcggcaccgcccctcaccctggagggtcctgtacaatctcatcatgggactcctgcccttacccaggggccacagagcccccgagatggagcccaattaggtgcctgcacccgcccggtggacgtcagggactcggggggcaggcccctcccacctcctgacaccctggccagcgcgggggactttctctgcaccatgtagcatactggactcccagccctgcctgtcccgggggcgggccggggcagccactccagccccagcccagcctggggtgcactgacggagatgcggactcctgggtccctggccaagaagccaggagagggacggctgatggactcagcatcggaaggtggcggtgaccgagggggtggggactgagccgcccgcctctgccgcccaccaccatctcaggaaaggctgttgtgctggtgcccgttccagctgcaggggtgacactgggaggggggggctctcctctcggtgctccttcactctgggcctggcctcaggcccctggtgcttccccccctcctcctgggagggggcccgtgaagagcaaatgagccaaacgtgaccactagcctcctggagccagagagtggggctcgtttgccggttgctccagcccggcgcccagccatcttccctgagccagccggcgggtggtgggcatgcctgcctcaccttcatcagggggtggccaggaggggcccagactgtgaatcctgtgctctgcccgtgaccgccccccgccccatcaatcccattgcataggtttagagagagcacgtgtgaccactggcattcatttggggggtgggagattttggctgaagccgccccagccttagtccccagggccaagcgctggggggaagacggggagtcagggagggggggaaatctcggaagagggaggagtctgggagtggggagggatggcccagcctgtaagatactgtatatgcgctgctgtagataccggaatgaattttctgtacatgtttggttaattttttttgtacatgatttttgtatgtttccttttcaataaaatcagattggaacagtg

SEQ ID NO: 110970 - DNA, 4687 bp, Homo sapiens
  Payload ID: 1770
  Gene Symbol: BMF
  Gene Name: Bcl2 modifying factor
  Uniprot ID: Q96LC9
  ENST ID: ENST00000354670
  CDS Start-End: 236-790
ggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagcaaa

SEQ ID NO: 110971 - DNA, 4545 bp, Homo sapiens
  Payload ID: 1770
  Gene Symbol: BMF
  Gene Name: Bcl2 modifying factor
  Uniprot ID: Q96LC9
  ENST ID: ENST00000397573
  CDS Start-End: 97-651
attttcccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttgtgttttaattttttttaatttctctctgagtgtacatacaacatactcaagcgggaccttctttctctgtcaggcccttgacctggaatgggggcctttgtcaaacactgttgaaggagaggctgatgtgtctgtgatggtgagaattcccaagggctctgacaagtagattcttcgactgaggaatctaccagttgtcgaagatgatccgttagtgatgttctctgggaagtggactgtggtttttccagaggaactcagttaagaaatcgagagtggattagactcccagttccaccaaacctatgagccttccactgtggatgggggccgtgatcctgatggtcacattgctttaacccagcagggcttcggccaggggctttccacttgaggatagcagcttcactaggctggccggccagctccacatctgactgggttcttacttctcagccagtacctgccccatgggctcaaggattcctggccagctcctgccacctccagcagacctcagggagggttgagtttctctaaggacccctcaaacatgtcgcaaaatgaaccaaacttctggctaggcctcaaaactgacttggtcccacttggaggccccaggattggtcctgaggtacagagccactgccaccactggcggcctgggaccagctgggtgtcagccacggatgagccgaatagccagtcagcatgttgctgctggcagcctgtgcctttgtcagctcttctttcaaaagaccccaccgacagaccgcattccacccccaacatcggcactgagggacatcgggggcaagtttgcagtggggccggaaaatatggtggccaccctaccatgagagtcagccgtaggggaccccagaccccttggtttccttggaaacaacatacctcttcccccttatccccagtcctttttcatacctagtgggatacagaagaagccaggacagtggctttgccagctaagtgacttttagagtaacagataacgattagagtggggaaccgtcaaagctgggtacacatttcctatcttcctccagcttccagctaggccagaagggcatgctctggaacccagcaggatcacagctgcctgtgcacgtcttcccttctctccctgctgcggcacttatggagaggatctaaagcagccggtgtggcagctccgatagcaggcacagggaatctgttaaccagacgctagaaactaaattataacttttgcatatgtgagaaaagacaacattggtgctaacagtgaagtaaggcccaaaggaaagacggcttccctggacaaagaagacctcagggctacccaaggaaataggaggagtctagagtagactcacaaatctgaacaagcccaagtcttccagttctgaggagaggaggtcttcagtactattgaaggagacattgatcttctggatgtacagttgtgcaggttgttcactgcacaagggcacctgcagctaatggaggctggaattcagcttgtgttctgctcactaagctgtgtgcgtgccctggtgtggggctacttctcccaagaagaaggggtgcctttcctaatttgcaaaggtgccatatgggctcacagcaccctggaggagaagggcctcaaactgtgcatgtaagcctttgttttgttctgctcagatattctggatattacctcttcttggtcagaattctattctcagggtgtgtaccatgatttgtctgctaagaagacgggttcctgctttgcagagaaggagccggggaccagcttgaagactggctctgggacacactgaccattgtgaaattcagccttccctgtgggtctccataccattttatgatgtgtatgggacatacgttgttctcccctctctggatcaaggtggtgacaggcagcctgctgccgtatgcttcagtggcacacaccaaaaaaccgggattatttacagcagccactattcaccccttttggcagactctccacctgagttcagtgagagagaaaatgatttagatcttggtgctggggcaaggccatcagcttcagagaccttgccaggcccaggctgggtgccctgtggcctgagaactgagcccagactttgacaaacccacctcaacatcaagcctggggcaggtggaaggtggtctgactgcactgtctccatcttatgcaaagccaggaactcactcactgtcttaagtgagccagggcaaaatttacacccctcacgtttccctctcccttcttccccaccaacaaaacccaggaggtagctggcagagtagctgtcaggaaggagaaaggttctttctggctggttgtttttaattggcttagtgatctaaactggccccttcctcctctgcctggtgagttggcctaaacattcctcaagtctagcctcaggagacctgcccctcccccccgacctccaccccctcagactccatcccccacccccaggagcctggctgtctctagcgaggggtggagaatcagatttagagggagggagagtctgacctggatcctgacctgtaaccagctgaagacggtggaggctttgtggcttgctgagggtgggggttgggagagggactggaaaccttcctcctcgggaaagaaatgcctgggaggaagggaagcctgatattcagggtcaaaacagcccttctaattcacaaccccaaagcaggggtttctagaagttggtcaacagatctggtgagggaagtccccaggccagacgctggactcctgcaatgagggtggaggactcagcctggcctctgcctggcctgtttcaaagtctgggccactggcagccttctcttgctcaatccgaggtggaaaaagatcacctcccagtgacctccctcagcccccaggggagtaggtctgtgtccaaagctatgtggcaggcttgtttgaaggacccagaggggcccagctgacctgtctcactgctcctggcagcccagccccatcggcaggtggcccctgcctgggggttattcgggatggttcagccagggcctcccaggaagagtgctgtggagccacggtgactgtcctggacagcaaggagcatgctaccccagtgagcacttctttttgagggacttgatggggaggtggggtaggcagaagggacgtggcagaagcgggaagactttggtcaccatggctctgcaggccttctgcaaatcagtgctggcctgggctggaaacagctctgtgtgtgaaggtgaggactcttggaagcaggccatcctggccagacaccctagcaggaaggggctcacctgtcacccttaggcagcctgagggctggtggggacttttgagtcttgaggggatagcggaaaaagctgagctcataggtgcccagccagcctcccagctaaaggtgctcagagccccactgccccctctctctgtgcaggtggccagtgcccctccctgctctgggagcattgctagccttctaccccatccctggatccacaggggctatcgaggagacccagtgagaatgtagcattttgttcatccccagggtagctgccctggggtctgggcactctgcctctgggagagaggaagaagaaaggggccccattttttaaaaaactgtacagagcctttggctttatgtgtttatgttcttcacatgcatatgtgtgtatgtgtgtatatctttccccccatcaattggtacaatttttaataaaatcatttaaagc

SEQ ID NO: 110972 - DNA, 492 bp, Homo sapiens
  Payload ID: 1770
  Gene Symbol: BMF
  Gene Name: Bcl2 modifying factor
  Uniprot ID: Q96LC9
  ENST ID: ENST00000431415
  CDS Start-End: 1-492
atggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagagcaccagcagaaccaaaatcgtgtgtggtggcagatcctcctcttcctgcacaaccttgctttgaatggagaagagaacaggaacggggcaggccctaggtga

SEQ ID NO: 110973 - DNA, 490 bp, Homo sapiens
  Payload ID: 1770
  Gene Symbol: BMF
  Gene Name: Bcl2 modifying factor
  ENST ID: ENST00000560430
  CDS Start-End: 452-490
ggagtcgcgctgcgcacgggggcccgggaagggtttgggctgcggacgtctggggtgaccatgaagaactggggcgctggggtgagggaacggggtgcagaacccacagttgggtgcgctgctccaagagggaacttgggggtagcatttgggactcgaaggagttgggtccaggtaggcaggggaacctggggtgcactgctgagcagacctgggcgcccgagaacggcccagcctctgggtctgactttgggataggacaggagctgtggggcatcctgcctctctgcggagtctgaaggctcctctccttaacagctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgat

SEQ ID NO: 110974 - DNA, 747 bp, Homo sapiens
  Payload ID: 1770
  Gene Symbol: BMF
  Gene Name: Bcl2 modifying factor
  Uniprot ID: Q96LC9
  ENST ID: ENST00000561282
  CDS Start-End: 124-678
tagctgctgattctactcctgctattgctcacaaccctcagagtcaaactttgtgaccggcctaggtcagaaaacgtgatcaagaaaaagggtggttccaggcgggcccagggaagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggac

SEQ ID NO: 110975 - DNA, 735 bp, Homo sapiens
  Payload ID: 1770
  Gene Symbol: BMF
  Gene Name: Bcl2 modifying factor
  Uniprot ID: Q96LC9
  ENST ID: ENST00000561360
  CDS Start-End: 70-624
gctgtcctaggattgctggcttttgtttttgctgctgagcctggagctcagctcagactgagaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatggcaatgctggctatcggcttcctctccctgccagtttcccagcagtcttgcccattggggagcagccccccgaagggcagtggcaacatcaagcagaggtacagattgcccgaaagcttcagtgcattgcagaccagttccaccggcttcatgtgcagcaacaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaaggacatcgggcaggactgacactgtgtcttgtgaaattgtttttttgttgttattttg

SEQ ID NO: 110976 - DNA, 671 bp, Homo sapiens
  Payload ID: 1770
  Gene Symbol: BMF
  Gene Name: Bcl2 modifying factor
  Uniprot ID: Q96LC9
  ENST ID: ENST00000558774
  CDS Start-End: 225-614
cccgagcaggcgtattttggaaacaataccgcaccgtgcggagtggcctcctcccgccccggcctgtgcccgccgccgccgccgcccctgcctgcgcctcccgcctcctgccgcagcccgtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctaggtgagggtgggctgccctcttcacatggggcaccaggaacaccgtctggaacaggaa

SEQ ID NO: 110977 - DNA, 630 bp, Homo sapiens
  Payload ID: 1770
  Gene Symbol: BMF
  Gene Name: Bcl2 modifying factor
  Uniprot ID: Q96LC9
  ENST ID: ENST00000559701
  CDS Start-End: 241-630
attttggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgacccaccagccaggaagacaaagctacccagactctcagcccagcctcccccagccaaggtgtcatgctgccttgtggggtgactgaggaaccccagcgactcttttatgcaccagcagaaccaaaatcgtgtgtggtggcagatcctcctcttcctgcacaaccttgctttgaatggagaagagaacaggaacggggcaggccctag

SEQ ID NO: 110978 - DNA, 505 bp, Homo sapiens
  Payload ID: 1770
  Gene Symbol: BMF
  Gene Name: Bcl2 modifying factor
  ENST ID: ENST00000557870
  CDS Start-End: 322-505
attttggaaacaataccgcaccgtgcggagtggcctcctcccgccccggcctgtgcccgccgccgccgccgcccctgcctgcgcctcccgcctcctgccgcagcccgctgggctttttccctccttcccaatcgagtctgggcgtccagcccccgagtgctcgtcacgctggaccctggcgcggagccctggcatcacgactcggaggccgagactctctcctggagtcacccaggtaccctgcatgcatatagctgctgattctactcctgctattgctcacaaccctcagagtcaaactttgtgaccggcctaggagagatggagccatctcagtgtgtggaggagctggaggatgatgtgttccaaccagaggatggggagccggtgacccaacccgggagcttgctctctgctgacctgtttgcccagagcctactggactgccccctcagccgacttcagctcttccctctcacccactgctgtggccctggccttcgac

SEQ ID NO: 110979 - DNA, 2336 bp, Homo sapiens
  Payload ID: 1771
  Gene Symbol: BNIPL
  Gene Name: BCL2/adenovirus E1B 19kD interacting protein like
  Uniprot ID: Q7Z465
  ENST ID: ENST00000295294
  CDS Start-End: 610-1437
gagctacaacagctgagacagaaaagaggtaaggaagtgttgggggctgggacaaccagctccccaacaactcctaggtgtttaaagaaggaggcaggaagacttgtgaagatgggaactatacaagaggcaggaaaaaagacagatgttgggtggagcaactgctacagaggtaaatatgattaactttacattccatctttcgtctgctcccaaacttaacagcaggtaatctgcttctagcaagtggtgaaggtaagagaagcatctgtataggaggcaagagatctgagtccttttgaaggcctatcctctgctctgtatctcaattactgttcttcatttcaattattcttacctactattcagttcccttgatcttttcttcttgggggctgtcttagggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaa

SEQ ID NO: 110980 - DNA, 1183 bp, Homo sapiens
  Payload ID: 1771
  Gene Symbol: BNIPL
  Gene Name: BCL2/adenovirus E1B 19kD interacting protein like
  ENST ID: ENST00000361277
  CDS Start-End: 1-1025
tcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactt

SEQ ID NO: 110981 - DNA, 2143 bp, Homo sapiens
  Payload ID: 1771
  Gene Symbol: BNIPL
  Gene Name: BCL2/adenovirus E1B 19kD interacting protein like
  Uniprot ID: Q7Z465
  ENST ID: ENST00000368931
  CDS Start-End: 157-1230
gaagatgaggttacctcccttccacacctccctccttggaggcaagagctacaacagctgagacagaaaagaggtaaggaagtgttgggggctgggacaaccagctccccaacaactcctaggtgtttaaagaaggaggcaggaagacttgtgaagatgggaactatacaagaggcaggaaaaaagacagatgttggggtcagggagattgcagaagcaccagaactaggagcagccctgagacatggggagttggagctgaaggaggaatggcaggatgaagaattccctagattgcttcctgaggaggctggcacttctgaagatcctgaagaccctaaaggagattcacaggcagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatagcacaggactggataaaaggccttagaaccagttagtgatctgcctacacctgaatccctgaaacatctgaactgttttgtaaatcatcttatccccaacctcagtaccaccggatcttcacttctcagtgggattttgtcctttgcatgaccctactttcagcagggctttgaggctgggaaactgatctgctgggtgactttcattccagttgctgggacggaaggctgaatgtagggtcattttgtatgggatatgcagagctctgggtttttttgttttttgttttttgagacggagtctcgctctgtcgccaggctggagtgcagtggtgcgatctcggctcactgcaacctccgcctcccggttcaagccattcttctgcctcagcctcagcgagtagctgagactaccggcgcacgccaccacgcccagctaattgttttgtatttttagtagagacggggtttcaccatgttggccaggatggtctcgatctcttgacctcgtgatctgcccgcctcggcctcccaaagtgccgagattacaggtgtgagccaccgcgctcggccagagctctgggttttaatcctactttagctgtagaaccttgggcaaataacttcatctttttgggtcctaattttcctcctgtctaactggagggactgtgatccttccaccttggatggaagaggcttacctgacagccagcctgcctgctgggagccaggagagtcagctcattaaatcttgaagaaccgctgtatgccctttttccttctaagtcatgtctgctgcctgtgagcctgggaaggagtgctttcaaaacctgtatttttgccctctttagtaaatttagaactgtagaggctaataaactgcgatgagacatttaagctctgctccaaag

SEQ ID NO: 110982 - DNA, 510 bp, Homo sapiens
  Payload ID: 1771
  Gene Symbol: BNIPL
  Gene Name: BCL2/adenovirus E1B 19kD interacting protein like
  ENST ID: ENST00000392802
  CDS Start-End: 211-510
gcataggtgataaaatcatggtggggagagagaacctatatattgagtcctggcttgatgcctttggtgtatatgtctgccgccttttaatctcttcccctctagattgcttcctgaggaggctggcacttctgaagatcctgaagaccctaaaggagattcacagctgcaggtacccccagcactttagccctgtgtggccagcgccccatgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccga

SEQ ID NO: 110983 - DNA, 982 bp, Homo sapiens
  Payload ID: 1771
  Gene Symbol: BNIPL
  Gene Name: BCL2/adenovirus E1B 19kD interacting protein like
  Uniprot ID: Q7Z465
  ENST ID: ENST00000485855
  CDS Start-End: 1-615
atgcgcaagcgtctttctgccccagagttgcggctgagtctgactaaggggcctggaaatgatggagcttcacccacccagtctgcaccttcctctcctgatggcagttctgacctggagatagacgaattggagacaccttcagactcggagcagctggacagtggacatgaatttgaatgggaagatgaactaccccgggcagagggtctgggcaccagtgagacagctgaaaggctgggccgaggttgtatgtgggatgtgactggagaagatggacatcactggagggtgttccgaatgggaccacgggagcagcgcgtagacatgactgtcattgagccctataagaaagtcctgtctcatggaggttaccacggtgatggcctcaatgctgtcatcctttttgcttcctgttatctacccagaagcagcatccccaactacacctatgtcatggaacacttgtttaggtatatggtgggaactctggagctgctagtagctgaaaattacctgcttgttcatttgagtggaggcacaagcagggcccaagttccacctctaagctggatacgtcagtgttaccgtaccctggatcggcgagttttataagtaatcttggtcatggagcgatgtagaagcatgcaaaaggaacttacgcgagggtagagcacaagatggaaatggagcagaaaaagaccaggtggtcgggcgcggtggctcacgtctgtaatcccagcactttggaaggccgaggctacggaaaaacctgcgagccctggtggttgtccatgctacatggtatgtgaaagcatttctggcactgcttcggcccttcatcagttccaaattcacacgaaaaatccgttttctggacagcctgggggagctggcccaactcatatccctggatcaagtccacatccctgaagctgtcagacagctggaccgggatctccatggctcaggagggacatag

SEQ ID NO: 110984 - DNA, 1339 bp, Homo sapiens
  Payload ID: 1772
  Gene Symbol: BNIP1
  Gene Name: BCL2/adenovirus E1B 19kDa interacting protein 1
  Uniprot ID: Q12981
  ENST ID: ENST00000231668
  CDS Start-End: 105-920
ctctagggggcgctgccccgagactgggtggggagggaaagaaggtggtgcgaaaacgcgtttgaacttgggtcctgccgctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataa

SEQ ID NO: 110985 - DNA, 1143 bp, Homo sapiens
  Payload ID: 1772
  Gene Symbol: BNIP1
  Gene Name: BCL2/adenovirus E1B 19kDa interacting protein 1
  Uniprot ID: Q12981
  ENST ID: ENST00000352523
  CDS Start-End: 10-723
gtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacagccagttctctatcaaagggcatttatttggactgcttccacatttttttttaagctaacttattccctgacagacttttcttcaactcagcatgacttcaactctccaactacacctgttaccttcagtgacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaa

SEQ ID NO: 110986 - DNA, 1184 bp, Homo sapiens
  Payload ID: 1772
  Gene Symbol: BNIP1
  Gene Name: BCL2/adenovirus E1B 19kDa interacting protein 1
  Uniprot ID: Q12981
  ENST ID: ENST00000351486
  CDS Start-End: 32-718
cctgccgctgcccgtagccggcgtccccaacatggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcagcaatcaggcctcatggaggaaagctaatctcacctgcaaaattgcaatcgacaatctagagaaagcagaacttcttcagggaggagatctcttaaggcaaaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagtgccccacttttctgcaagtagctggcttgtaaagggtgaacagagccatgggaggaaggtctggcattgggatgccgccctggggacatacgaaccgcctccttccaccattgtgcactatgggaggccgctgctgcgtggagcacttaaagtccagcctccaggaccggatgcccctcctgtctcccgctcccatcgtgcccttaaatgccagatctggtggagggaagagagaagaggtaggaagaaaggtgatgaaaactcctggtcattccttgaataaacttgattttatttaatagaataaaatgtatttgattttgtaagata

SEQ ID NO: 110987 - DNA, 721 bp, Homo sapiens
  Payload ID: 1772
  Gene Symbol: BNIP1
  Gene Name: BCL2/adenovirus E1B 19kDa interacting protein 1
  Uniprot ID: Q12981
  ENST ID: ENST00000393770
  CDS Start-End: 1-585
atggcggctccccaagacgtccacgtccggatctgtaaccaagagattgtcaaatttgacctggaggtgaaggcgcttattcaggatatccgtgattgttcaggacccttaagtgctcttactgaactgaatactaaagtaaaagagaaatttcaacagttgcgtcacagaatacaggacctggagcagttggctaaagagcaagacaaagaatcagagaaacaacttctactccaggaagtggagaatcacaaaaagcagatgctcaggaaaaccaccaaagagagcctggcccagacatccagtaccatcactgagagcctcatggggatcagcaggatgatggcccagcaggtccagcagagcgaggaggccatgcagtctctagtcacttcttcacgaacgatcctggatgcaaatgaagaatttaagtccatgtcgggcaccatccagctgggccggaagcttatcacaaaatacaatcgccgggagctgacggacaagcttctcatcttccttgcgctagccctgtttcttgctacggtcctctatattgtgaaaaagcggctctttccatttttgtgagatcccaaaggtgccagttctggccctttcagctcctgtttcaggatctgtcctggttcctgagctctaggctgctaagctgagccacacacccctccgtttgcaccagttgcctgcaggttggatggaacacagt

SEQ ID NO: 110988 - DNA, 1130 bp, Homo sapiens
  Payload ID: 1772
  Gene Symbol: BNIP1
  Gene Name: BCL2/adenovirus E1B 19kDa interacting protein 1
  ENST ID: ENST00000519459
  CDS Start-End: 1-123
actgagagcctcatggggatcagcaggatgatggcccagcaggtccagcagagcgaggaggccatgcagtctctagttccttttaaaagatgtgaatcagaggctacaggagagactgcttgagaccatctggtttcctccaatagttttcccagagtgtctcctctgtgatggagaagagtatcagccctctccagggtccttcagtataagacaacagaaaaagggcgtttactccttgaaacgcttttggaaaattgcacacgtggacaaaaggagaaagcatggtatcctgaatcccctgagccctgagtccattaccccagccagtctcgtttcagttctaccctcagcccatcccccatctggattattttgaagcaaatcccagacatcatccataaatatctcagtacatctctctaaaagataagggactctttggggaaaaagcagaagcaaccccataactacaataccatgatcacccctagaaattataattttggaccactgttttttcagtgcaccaaataggcagaagcaaaaggaaagcaagcaggtgaccccaaggtcactccttgagtttgcagcttacctgaacatctgggctcggaaccagccaggggcttcctctcagcgtgtgctgtgggagaggccttggagagagagggagcaaggcgacaacttggcctctgagcccagggcttttatgctctggtgtggcgacagcataccccccgctaacagtgggaaggaaacacaaatgctggtggcttctggggtgttgagagggtcccggtgttcttggggcccattttgtacaagcgataactattgaagaaaagagaagaatacagttcttaaccctttccttatgcctcacaaattcagcttgatttaaaagcctactaggaccataattttaaaacaaaaagcttattaggaatatggtgtctggaatttgctccacaattgcaggagtagttgcagttggggggagggggagcaggatttcagaggttggtggttcttggttatgggtggtggacacatggcatttcatgatattatgctgtctgctctgtgatggttcaaaattctccgtaataataaagtttaaaaagaaa

SEQ ID NO: 110989 - DNA, 6325 bp, Homo sapiens
  Payload ID: 1773
  Gene Symbol: BNIP2
  Gene Name: BCL2/adenovirus E1B 19kDa interacting protein 2
  ENST ID: ENST00000267859
  CDS Start-End: 95-1402
agtcgacgcgacgggtccgcccacaggcaaggaaggccgaccccgcgagtgcaggcgcgagcgctagcccgtgacgtctgagggggttggggggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacacttgttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgctcaaaatgggctgaggtttttaataggtggttttctaccacattaagtacttggttcttcagtttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatttcccatattattccattttaatttcccattactgaccaaggtgaaagtatatgtgattgtacttttatctttctgttgggatcatggatctaatttaactggcttaatttgatgcttctgtcactaggctctaagtgccccttttttagtcagaagtttttcatgtgaaataatttgattctgtgttctgcttgatcatactcctaagcaagcaccaagggaagacgttctattcaccccacaatttaagcttaacaatctttaactcagagggagatatgaagaaatatgattctaagtagggtctagcagaggcattggaaagtgataaaagtaggaagtaagagaaagcaaacctttataaagagataaagacatagttgttacctaagatgccactgtatgtgtgccctctctttttttttttttttttttggagacagagactcactctgtcacccattctggagtgcagtggcgcaatcctggctcactgcaacctctgcctcccgggttcaagcatttctcctgcctcagcctcctgagtagctgggattacaggcacacgccacaatgcccggctaatttttgtatttttagtagagacggggtttcgccatgctaggctggtctcgaactcctgacctcatgatctgcctgtctcagcctcccaaatgcttggattacaggcttgagccaccacgcccggccatgtgtgtccttttaagggaagtaccatatgtgactgctgatggtaacatttcttgtatgcagcaggaaaacctgcaggctatacgcaaggtatgtgaataaagactgtggattgaagggggaaaagttgataatacatacccatgataagaattcatattttctctttctttgtctcttcatacagaagcaagttcgagcagagaaggttagcagttacagcacttaaaagtttaggattgagggtttttggttggtttttttgttttttcatatttcactgttgctgaacattgatttagtcttccaaaatggacatcactagtaagtgcactgaatactgaaatatgctgattggcaagcatatatctgtagctagaatttttttaaccgtaattccagaatttaaaaaggtaagagatctgctttttgatagaggccttttaaaaagactatataacatttctatttggctgtttatgtgaatgctcagggaatttggacatgtgttttatacagaagtggctttttatatttcttcaagtgataaattagcattaggacatatcagatagaacaggccagtttcctgatgagattggtagagatgttacggtaggttcatccttcctttttccatgttatatgtggagaagtgttaaacttgctcaagcaaatgggagtaggagataggctgaaaatagagattgctacaccattctattttgttttcatgcctgttttttctccaatcctatatggacatttgagaaatggaccacaaatctgagagggatagagtaaaaagaggcattaatgtatgtactcacaagttagacctattttgctgttaaaataggtctggtcttgttataggtcataggaattgtgtagtttgagttgctgcgagaaagagtcaagaacttagacttgaatgggaaggccaactggtgagggaagtggggtattatctactcaaatgttctaagctaatacaaaagaattacctggcaagcatccccctctgcccttcttgaaattctgaatgaacttagaatcagatcaatggtgagacccagttatgtaactttcctttgaagttctaaaggataattgaaaataaagtagtctggcatgtttaacagtaaggagtgacactaaaatttgaatataacagtatgttgcaactatttataatagacctatttatgttttgagaactaagtaaaatgctatgaaaaattcacataaagcacgtaagcaccaaatgaaaatcatttcgtgctttcaaattaatgatactaggcttgtaggatgtcttagaatcatgtttaacaagaagttaaaatatttgcattttgaaatttttatgcagtttggctaaggaggaacttggaaaataacattcatcagcttctacactgcactttttgtatgtggactttgtaaagtttaatgtccgtttaacagttgcttgtttatttgtgtaaacctagctagtaaatattgatgatgttcagggccactgacttgcacagcccttggagcactattcacacagaacacaattcagagtttgttaagacattaacacactttgatatctattccaaaaatacttttgttaccacaggttcattgctgtcatttagacaaaattaatgtactgtgatattttcctactcttaagatgatgttgcccagccgagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgtt

SEQ ID NO: 110990 - DNA, 1305 bp, Homo sapiens
  Payload ID: 1773
  Gene Symbol: BNIP2
  Gene Name: BCL2/adenovirus E1B 19kDa interacting protein 2
  ENST ID: ENST00000439052
  CDS Start-End: 1-615
gaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaag

SEQ ID NO: 110991 - DNA, 806 bp, Homo sapiens
  Payload ID: 1773
  Gene Symbol: BNIP2
  Gene Name: BCL2/adenovirus E1B 19kDa interacting protein 2
  ENST ID: ENST00000448414
  CDS Start-End: 1-262
agatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaa

SEQ ID NO: 110992 - DNA, 1509 bp, Homo sapiens
  Payload ID: 1773
  Gene Symbol: BNIP2
  Gene Name: BCL2/adenovirus E1B 19kDa interacting protein 2
  Uniprot ID: Q12982
  ENST ID: ENST00000415213
  CDS Start-End: 67-1197
ctgtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtg

SEQ ID NO: 110993 - DNA, 1851 bp, Homo sapiens
  Payload ID: 1773
  Gene Symbol: BNIP2
  Gene Name: BCL2/adenovirus E1B 19kDa interacting protein 2
  Uniprot ID: Q12982
  ENST ID: ENST00000607373
  CDS Start-End: 204-1148
tgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccatt

SEQ ID NO: 110994 - DNA, 2515 bp, Homo sapiens
  Payload ID: 1773
  Gene Symbol: BNIP2
  Gene Name: BCL2/adenovirus E1B 19kDa interacting protein 2
  ENST ID: ENST00000612191
  CDS Start-End: 4-1311
gggatgctgtgtgggtttcaagaagacgccacgcctccgccgccgccacgcccccgccgcctccaccgccggctgccgcgcccggaggaggtcgggatgttatcacttccgccggggcttctcactgtgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtttttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctcc

SEQ ID NO: 110995 - DNA, 2861 bp, Homo sapiens
  Payload ID: 1774
  Gene Symbol: BNIP3
  Gene Name: BCL2/adenovirus E1B 19kDa interacting protein 3
  Uniprot ID: Q12983
  ENST ID: ENST00000368636
  CDS Start-End: 13-792
aagtcgcggccaatgggcgacgcggccgcagatccgcccggccccgccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcagattactgtatttacatatggtttaaaatcagacgtcatgatagcttcttaatgaaaccaggactggtccctattttgacattatctttcctacagcaaactttttagaaaggctgcctgccgccttgatgtttcacctttccacgcttaattcgggtgttaaatctaacgttttcatttgtaaaaatctttgttgatgctaccttggaagcagtcatctctcagtcttacatttggagaatgtggatggcatgacatcagaattcctttatataatttaacttcagaatagtctgagatcatcgaagcacgatggtcaagggaattccgtttttgttttagagcaaatatgtttgctgtttgtctttcatcacaaacatcagtggagtttcagcaccttacagagctcagtgaaccccctggtcaccatcaaagttagcacacaacaaagccaaccacgtgtccccctcacagatgacaatggctgaactctgagtgaaaccacctgtatggccgggcacagtggctcacgcctgtaatcccagcactttgggaggttgaggtgggtggatcacctgaagtcagaagattggcctggccaacatgatgaaaccccgtctctaataaaaatgcaaaaattagctgggcgcagtggcacgtgcctgtaatcccagctacttgggaggctgaggcaggagaaccgctggaacccagaaggcagaggttgcagtgagtggagatcatgccactgcactccagcctgggagggagaacgagactccatctcaaaaaaaaaaaaaaaaacaaccagttggaggtactaagctctgggactgggccagtgtgatggctccacacctgtaatctcaacactttgggaggctgaggtaggaggatcacaagtccagaagttcgagaccagcctgggggagcatagcaagaccctgtctctacacaaaatacaaaaattagcctcgtgtggtggcacacacctgtagccccagctacttggtagactgaggcaggaggatcccttgagcccaggagttcaaggctgcagtgagccaggatagtgcacacggcctgagcaagagcaagaccctgtttcagaaaaaacaactctgggactggagtgctttagacagatgggagaccaagaatcaagttttctggaggtgtttttcgttagattgtaacattagacattttattaaaaatgaaacaagtttga

SEQ ID NO: 110996 - DNA, 3066 bp, Homo sapiens
  Payload ID: 1774
  Gene Symbol: BNIP3
  Gene Name: BCL2/adenovirus E1B 19kDa interacting protein 3
  ENST ID: ENST00000540159
  CDS Start-End: 1-660
agtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggtaggtgatgtgactgtgtgactcctgtcatggcatgtcgtggggcgattctgggttgcagtgatttattcgtaacctgtttcctgaagtccagatcatcagttacagcttggtgcattttcacaaacacccacgtagtcactgttcaggtccagaaaccaccagcctgcagcccccaaaggccccagcacaggcgccctgtggtgctgctgtctggcctgacgagtctgcctgttgctcactgaatataaacggagtcaaagcagggcttcttaggtctgacctctttgtcctgtgtgtaggtgaaagcagtctcatttctgtgtagtactgtggcgggaatgcacccagctctgctgtaggtggagggtctcagttacctgctgtacttcctccagacaggactgttgttctagtaactctcagcaatgaaggaaccaatgcagtctccgactttactggcttgagtttcgctcttgttgcccaggctgagtgcaggggcgtgatctcggctcactgcagcctctgcctcctgggttcaagcgactctcctgcctcagcctcctgggtagctgggattacaggtgcccaccaccaggcctggctaatttttgtatttttaatagagacggggcttcgccacgttgcccaggctgatctcgaactcaagggatggctcacctcggcctccaaagtgctgggattacaggcgtgagccaccgcgcctggcctttcctggctgcttatactcactcaccctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttaggtaggttggccagagggctcacatctggggttgaaggaaacgggataaaagccactgagtttcctgggccgggacctgagcgctgcccgtgtctccacctcgccctcccgtgtgcgtggctttctcctagctcttgggcacattctcacgtcccccccataacccgtcaccttcatttctgctggtgcttttgggagtcagacctacagactgcatcagcatcaccaggcagtttgctttctggagccttttccagaactgtcaagcagactctgggggcaaggcctcgggatcctcattttaaatacaaggtttaagcccttcgtttcaggatggatttctgcagccactacttcccagctactgtccttcgtcctgcccgggttttcagagcctgatgctgccactggcgacccacaccccctcagctgcttttcagaaccacacgataaaatctgccccgaaagctgctgcagcactgtctgcgctcacagtgcccaccacaccaccgcccacaggccaggccagccaggcttccgattctgccctttcctggagacccatcctcctccctccgggagtgatgcccgctggtcagctggagcgagcctctctattgccgaaaagccttttctgacactcctgcatctttagtttgggacatctctcccactaccaaacttaaaccacatgagggcaggggcttcatttttaagcagttggctttggtgaggctggtggtgatgaactagcaacaccatcttgccctggtaggtgacttcccccagcactgagttggaacaaagcagaagctttctgtgtggaaacagcattcggtttggtgatccttctatgtaagaatacgatctgatgttttctaagttaattaatacaaaatacatattgataaaacactagataaaagatcacagatagattcattacaaaatttttataatgggtataaaatcaccagtccccttgcataagctctaaccacagtgagctaccctgtttcagctgtaacacagtctcctgtgaatcacaagatacattaactactgataatttttctgtgaaggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatat

SEQ ID NO: 110997 - DNA, 1062 bp, Homo sapiens
  Payload ID: 1774
  Gene Symbol: BNIP3
  Gene Name: BCL2/adenovirus E1B 19kDa interacting protein 3
  ENST ID: ENST00000633835
  CDS Start-End: 1-731
ccctgccctgtgagttcctccggccgggctgcggggctccgctcagtccgggagcgcagctgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagagcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattgggagacggggcttcgccacgttgcccaggctgatctcgaactcaagggatggctcacctcggcctccaaagtgctgggattacaggcgtgagccaccgcgcctggcctttcctggctgcttatactcactcaccctgcagaaaacacagagaccaggcaggcgccgctgtgggttctgaagagcgttcgccgcagcggtggtgaagagccagagcgggaagccaaaacggctcctcctcgggctggtcccagcctctcagcggggaggagggctctagtcctggcgtgcagacagtgttctgtggctgccgtgtgttggacagactggaaagaccggaatgccactgggggcaggtgggttagg

SEQ ID NO: 110998 - DNA, 3610 bp, Homo sapiens
  Payload ID: 1775
  Gene Symbol: BNIP3L
  Gene Name: BCL2/adenovirus E1B 19kDa interacting protein 3-like
  Uniprot ID: O60238
  ENST ID: ENST00000380629
  CDS Start-End: 234-893
gcgcgtcagcctgactcgagcgtctccacgtccggggcccgcaggggagcgcccctgccccgtccggtcgcttgttgtgttgtcatcacgtggcctgggcgggccctgacgtcaggggcaggggagggacggcgcaggcgcagaaaagggggcggcggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttataggaggcaaactgtataaatgataggtatgaaatagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatcatcacagtagaatttattatgagagcatgtagtatgtatctgtagccctaacacatgggatgaacgttttactgctacacccagatttgtgttgaacgaaaacattgtggtttggaaaggagaattcaacaattaatagttgaaattgtgaggttaatgtttaaaaagctttacacctgtttacaatttggggacaaaaaggcaggcttcatttttcatatgtttgatgaaaactggctcaagatgtttgtaaatagaatcaagagcaaaactgcacaaacttgcacattggaaagtgcaacaagttcccgtgattgcagtaaaaatatttactattctaaaaaaatgagaattgaagacttagccagtcagataagttttttcatgaacccgttgtggaaattattggaattaactgagccaaagtgattatgcattcttcatctattttagttagcactttgtatcgttatatacagtttacaatacatgtataacttgtagctataaacattttgtgccattaaagctctcacaaaactttt

SEQ ID NO: 110999 - DNA, 739 bp, Homo sapiens
  Payload ID: 1775
  Gene Symbol: BNIP3L
  Gene Name: BCL2/adenovirus E1B 19kDa interacting protein 3-like
  Uniprot ID: O60238
  ENST ID: ENST00000520409
  CDS Start-End: 103-642
ctctgttgcctcctggggtcttgggcccggggccgtttgggctcgcggtccgggagcggcgcgggtagcgcggatccccctggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaa

SEQ ID NO: 111000 - DNA, 922 bp, Homo sapiens
  Payload ID: 1775
  Gene Symbol: BNIP3L
  Gene Name: BCL2/adenovirus E1B 19kDa interacting protein 3-like
  ENST ID: ENST00000520077
  CDS Start-End: 78-260
ggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacatcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtcta

SEQ ID NO: 111001 - DNA, 875 bp, Homo sapiens
  Payload ID: 1775
  Gene Symbol: BNIP3L
  Gene Name: BCL2/adenovirus E1B 19kDa interacting protein 3-like
  ENST ID: ENST00000523949
  CDS Start-End: 1-558
gagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggatgtggaaactgatgtctagagaagctaagcaatttgcttacagtatgcacaaatctaccacaagactacacatcaactgtgttggagatttgcctagcacatataactaaatggtgctcatctgcactgcactcacacacttacgtgatacacaggtctgatctaaatacacaggtctgatctacacaaccatgtggtgctaccgcttttaaaatctgtgaacaattaaaagaagtttggatacgtacacagataccataaaggaaactttgctctaaggtctgcacaaaatgagccaatctgaaaataaaagtaaacctggtggtgaa

SEQ ID NO: 111002 - DNA, 915 bp, Homo sapiens
  Payload ID: 1775
  Gene Symbol: BNIP3L
  Gene Name: BCL2/adenovirus E1B 19kDa interacting protein 3-like
  Uniprot ID: O60238
  ENST ID: ENST00000523515
  CDS Start-End: 122-661
ctgtcaagaggaggggcgcctgccttgctccgggcctctctgttgcctcctggggtcttgggcccggggccgtttgggctcgcggtccgggagcggcgcgggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaa

SEQ ID NO: 111003 - DNA, 1352 bp, Homo sapiens
  Payload ID: 1775
  Gene Symbol: BNIP3L
  Gene Name: BCL2/adenovirus E1B 19kDa interacting protein 3-like
  Uniprot ID: O60238
  ENST ID: ENST00000518611
  CDS Start-End: 177-716
gtggctccaccccttcaactttttgtccaagaaaacttttcgtgtttgcctgtagctgatgtgcagttgtttctgctcccaaatcaacagggtttaatgaaaaccctagaaagtagaaacccgtgggagagaaaagaaaaaagacaagttcacaaggttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaagaaaacaaaacaaaaaaaaaaggcaaggcacaacaaaaaaatatcctgggcaataaaaaaaatattttaaaccagctttggagccacttttttgtctaagcctcctaatagcgtcttttaatttatagga

SEQ ID NO: 111004 - DNA, 1234 bp, Homo sapiens
  Payload ID: 1775
  Gene Symbol: BNIP3L
  Gene Name: BCL2/adenovirus E1B 19kDa interacting protein 3-like
  ENST ID: ENST00000620910
  CDS Start-End: 78-767
ggactcggcttgttgtgttgctgcctgagtgccggagacggtcctgctgctgccgcagtcctgccagctgtccgacaatgtcgtcccacctagtcgagccgccgccgcccctgcacaacaacaacaacaactgcgaggaaaatgagcagtctctgcccccgccggccggcctcaacagttcctgggtggagctacccatgaacagcagcaatggcaatgataatggcaatgggaaaaatggggggctggaacacgtaccatcctcatcctccatccacaatggagacatggagaagattcttttggatgcacaacatgaatcaggacagagtagttccagaggcagttctcactgtgacagcccttcgccacaagaagatgggcagatcatgtttgatgtggaaatgcacaccagcagggaccatagctctcagtcagaagaagaagttgtagaaggagagaaggaagtcgaggctttgaagaaaagtgcggactgggtatcagactggtccagtagacccgaaaacattccacccaaggagttccacttcagacaccctaaacgttctgtgtctttaagcatgaggaaaagtggagccatgaagaaagggggtattttctccgcagaatttctgaaggtgttcattccatctctcttcctttctcatgttttggctttggggctaggcatctatattggaaagcgactgagcacaccctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagtta

SEQ ID NO: 111005 - DNA, 2132 bp, Homo sapiens
  Payload ID: 1776
  Gene Symbol: BAK1
  Gene Name: BCL2-antagonist/killer 1
  ENST ID: ENST00000360661
  CDS Start-End: 301-876
gtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcagcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctg

SEQ ID NO: 111006 - DNA, 2136 bp, Homo sapiens
  Payload ID: 1776
  Gene Symbol: BAK1
  Gene Name: BCL2-antagonist/killer 1
  Uniprot ID: Q16611
  ENST ID: ENST00000374467
  CDS Start-End: 250-885
gccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctca

SEQ ID NO: 111007 - DNA, 2212 bp, Homo sapiens
  Payload ID: 1776
  Gene Symbol: BAK1
  Gene Name: BCL2-antagonist/killer 1
  Uniprot ID: Q16611
  ENST ID: ENST00000442998
  CDS Start-End: 301-762
gtctgcatccggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggccagcagcaacacccacagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgttcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatatcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccctg

SEQ ID NO: 111008 - DNA, 929 bp, Homo sapiens
  Payload ID: 1777
  Gene Symbol: BAD
  Gene Name: BCL2-associated agonist of cell death
  Uniprot ID: Q92934
  ENST ID: ENST00000309032
  CDS Start-End: 48-554
cggcaggcccgggtcaggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgc

SEQ ID NO: 111009 - DNA, 631 bp, Homo sapiens
  Payload ID: 1777
  Gene Symbol: BAD
  Gene Name: BCL2-associated agonist of cell death
  ENST ID: ENST00000394531
  CDS Start-End: 32-523
ggggcctcgagatcgggcttgggcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggagggagaacttcgtattctccttcttgggaatctgaggactctgaaaatcccagtgcagggatgctcgcggaagcatcagcagggatgtccgccccagccgctgactcagaagcccaacacgcagagaatgtaaagctagaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcct

SEQ ID NO: 111010 - DNA, 1157 bp, Homo sapiens
  Payload ID: 1777
  Gene Symbol: BAD
  Gene Name: BCL2-associated agonist of cell death
  Uniprot ID: Q92934
  ENST ID: ENST00000394532
  CDS Start-End: 272-778
gggcttggggtgagacctgtgcgccgtcaccacgggcggggcggggcctgggtccaccggggttctgaggggagactgaggtcctgagccgacagcctcagctccctgccaggccagacccggcagacagatgagggcccaggaggcctggcgggcctgggggcgctacggtgggagaggaagccaggggtacctgcctctgccttccagggccaccgttggccccagctgtgccttgactacgtaacatcttgtcctcacagcccagagcatgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacagccgccggaagtggctccgtggccccgccctcaggctccgggctttcccccaggcgcctgcgctaagtcgcgagccaggtttaaccgttgcgtcaccgggacccgagcccccgcgatgccctgggggccgtgctcactaccaaatgttaataaagcccgcgtctgtgccgcc

SEQ ID NO: 111011 - DNA, 325 bp, Homo sapiens
  Payload ID: 1777
  Gene Symbol: BAD
  Gene Name: BCL2-associated agonist of cell death
  ENST ID: ENST00000493798
  CDS Start-End: 134-325
ggcagggccaggggcttagaggagctgagattaacgtcgcccccctacccactgaccctctgcaggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggcacagcaacgcagatgcggcaaagctccagctggacgcga

SEQ ID NO: 111012 - DNA, 359 bp, Homo sapiens
  Payload ID: 1777
  Gene Symbol: BAD
  Gene Name: BCL2-associated agonist of cell death
  ENST ID: ENST00000492141
  CDS Start-End: 207-359
ggacacaggctaagagagtcgaaggctggctagacaaggggagagacacagagctccgctgatcatcactggactctggattccaccaaacctttggaaccttccagcctcaggcctccacagcttcacagaaactgggcgctggggctgtggagatccggagtcgccacagctcctaccccgcggggacggaggacgacgaagggatgggggaggagcccagcccctttcggggccgctcgcgctcggcgccccccaacctctgggcagcacagcgctatggccgcgagctccggaggatgagtgacgagtttgtggactcctttaagaagggacttcctcgcccgaagagcgcgggc

SEQ ID NO: 111013 - DNA, 525 bp, Homo sapiens
  Payload ID: 1777
  Gene Symbol: BAD
  Gene Name: BCL2-associated agonist of cell death
  ENST ID: ENST00000544785
  CDS Start-End: 2-475
catgttccagatcccagagtttgagccgagtgagcaggaagactccagctctgcagagaggggcctgggccccagccccgcaggggacgggccctcaggctccggcaagcatcatcgccaggccccaggcctcctgtgggacgccagtcaccagcaggagcagccaaccagcagcagccatcatggagaagggacttcctcgcccgaagagcgcgggcacagcaacgcagatgcggcaaagctccagctggacgcgagtcttccagtcctggtgggatcggaacttgggcaggggaagctccgccccctcccagtgaccttcgctccacatcccgaaactccacccgttcccactgccctgggcagccatcttgaatatgggcggaagtacttccctcaggcctatgcaaaaagaggatccgtgctgtctcctttggagggagggctgacccagattcccttccggtgcgtgtgaagccacggaaggcttggtcccatcggaagttttgggttttccgcccacag

SEQ ID NO: 111014 - DNA, 1128 bp, Homo sapiens
  Payload ID: 1778
  Gene Symbol: BAG1
  Gene Name: BCL2-associated athanogene
  Uniprot ID: Q99933
  ENST ID: ENST00000379704
  CDS Start-End: 243-935
ccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttct

SEQ ID NO: 111015 - DNA, 1396 bp, Homo sapiens
  Payload ID: 1778
  Gene Symbol: BAG1
  Gene Name: BCL2-associated athanogene
  ENST ID: ENST00000379707
  CDS Start-End: 392-874
gacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaaggttcttcaacagatatttattgaggacctgctaggtattggacactctcaaacacctggacaggtgtcagatttgaagtcttatgatgatggcagaaatctcaccattttcgatgaagctcatgggcagtcttccctcgctaggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttg

SEQ ID NO: 111016 - DNA, 485 bp, Homo sapiens
  Payload ID: 1778
  Gene Symbol: BAG1
  Gene Name: BCL2-associated athanogene
  ENST ID: ENST00000488499
  CDS Start-End: 342-485
ctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggcaatgagaagcacgaccttcatgttacctcccagcagggcagcagtgaaccagttgtccaagacctggcccaggttgttgaagaggtca

SEQ ID NO: 111017 - DNA, 681 bp, Homo sapiens
  Payload ID: 1778
  Gene Symbol: BAG1
  Gene Name: BCL2-associated athanogene
  ENST ID: ENST00000473781
  CDS Start-End: 231-681
gtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagtgagtgtcgggcgccaggcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagg

SEQ ID NO: 111018 - DNA, 3867 bp, Homo sapiens
  Payload ID: 1778
  Gene Symbol: BAG1
  Gene Name: BCL2-associated athanogene
  ENST ID: ENST00000472232
  CDS Start-End: 88-1125
aggccggggcggggctgggaagtagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaaccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaaaaaaaaaaaaaaattagcttggcgtagtggcatgtgcctataatcccagctactggggaggctgaggcacaagaatcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccaggagtttgagtctagtctgggcaacatagcaagaccccatctctaaaatttaagtaagtaaaagtagataaataaaaagaaaaaaaaactgtttatgtgctcatcataaagtagaagagtggtttgcttttttttttttttttggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccacaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacccttgtataggtgacttttgttcatccttcagaattcaactcacatgtctcttgcatggagaaccctcacctactgtgttgagaccctgtccagcccccaggtgggatcctctctcgacttcccatacatttctttcacagcatttacatagtccatgatagtttacttgtgggattatttggttaatctttgcctttaacaccagggttccttgggtgaaggagcttctttatcttggtaacagcattatttcaagcataacttgtaatatagttatattacatatataacatatatatatataacataacatatataacatatataacaagcataacttgttatatagtcttgtatatagtaagacctcaataaatatttggag

SEQ ID NO: 111019 - DNA, 658 bp, Homo sapiens
  Payload ID: 1778
  Gene Symbol: BAG1
  Gene Name: BCL2-associated athanogene
  ENST ID: ENST00000635077
  CDS Start-End: 377-658
ttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagtgagtgtcgggcgccaggcaatgagaagcacgaccttcatgttacctcccagcagggcagcagtgaaccagttgtccaagacctggcccaggttgttgaagaggtcataggggttccacagtcttttcagaaactcatatttaaggttcttcaacagatatttattgaggacctg

SEQ ID NO: 111020 - DNA, 3786 bp, Homo sapiens
  Payload ID: 1778
  Gene Symbol: BAG1
  Gene Name: BCL2-associated athanogene
  ENST ID: ENST00000634734
  CDS Start-End: 1-1038
ctggctcagcgcgggggggcgcggagaccgcgaggcgaccgggagcggctgggttcccggctgcgcgcccttcggccaggccgggagccgcgccagtcggagcccccggcccagcgtggtccgcctccctctgggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctccttctgtctctgtggttgtactgtccagcaatccaccttttctggagagggccacctctgcccaaattttcccagctgtttggacctctgggtgctttctttgggctggtgagagctctaatttgccttgggccagtttcaggtttataggccccctcagtcttcagatacatgagggcttctttgctcttgtgatcgtgtagtcccatagctgtaaaaccagaatcaccaggaggttgcacctagtcaggaatattgggaatggcctagaacaaggtgtttggcacataagtagaccacttatccctcattgtgacctaattccagagcatctggctgggttgttgggttctagactttgtcctcacctcccagtgaccctgactagccacaggccatgagataccagggggccgttccttggatggagcctgtggttgatgcaaggcttccttgtccccaagcaagtcttcagaaggttagaacccagtgttgactgagtctgtgcttgaaaccaggccagagccatggattaggaagggcaaagagaaggcaccagaatgagtaaagcaggcaggtggtgaagccaaccataaacttctcaggagtgacatgtgcttccttcaaaggcatttttgttaaccatatccttctgagttctatgtttccttcacagctgttctatccattttgtggactgtcccccacccccaccccatcattgtttttaaaaaattaaggcctggcgcagcagctcatgcctataatcccagcactttgggaggctgaggcgggcggatcacttgaggccaggagtttgagaccagcccaggcaacatagcaaaaccccattctgctttaaaaaaaaaaaaaaaaaaaattagcttggcgtagtggcatgtgcctataatcccagctactggggaggctgaggcacaagaatcatttgaacctgggaggtagaggttgctgtgagccgagattacgcccctgcactccagcctgggtcacagagtgagactccatctcagaaaaaaaaaaaattgagtcaggtgcagtagctccttcctgtagtcccagctacttgggaggctgaggctagaggatcacttgagcccaggagtttgagtctagtctgggcaacatagcaagaccccatctctaaaatttaagtaagtaaaagtagataaataaaaagaaaaaaaaactgtttatgtgctcatcataaagtagaagagtggtttgcttttttttttttttttggattaatgaggaaatcattctgtggctctagtcataatttatgcttaataacattgatagtagccctttgcgctataactctacctaaagactcacatcatttggcagagagagagtcgttgaagtcccaggaattcaggactgggcaggttaagacctcagacaaggtagtagaggtagacttgtggacaaggctcgggtcccagcccaccgcaccccaactttaatcagagtggttcactattgatctatttttgtgtgatagctgtgtggcgtgggccacaacatttaatgagaagttactgtgcaccaaactgccgaacaccattctaaactattcatatatattagtcatttaattcttacataacttgagaggtagacagatatccttattttagagatgaggaaaccaagagaacttaggtcattagcgcaaggttgtagagtaagcggcaaagccaagacacaaagctgggtggtttggtttcagagccagtgcttttcccctctactgtactgcctctcaaccaacacagggttgcacaggcccattctctgatttttttcctcttgtcctctgcctctccctctagctcccacttcctctctgctctagttcattttctttagagcagcccgagtgatcatgaagtgcaaatcttgccatgtcagtcccctgcttagaaccctccaatggctcactttctctttaggcaaaagtctttaccccatgccttctcccatctcatctcaaccccctcatttgttggctgtctgctgtcagccactcttctttcaggtcctcagatgcactgcaccctctcctgcctgggggtctttgctcctgctactacctctgcttgaacagctcctcaccttccttcctccaaccctacccttgtataggtgacttttgttcatccttcagaattcaactcacatgtctcttgcatggagaaccctcacctactgtgttgagaccctgtccagcccccaggtgggatcctctctcgacttcccatacatttctttcacagcatttacatagtccatgatagtttacttgtgggattatttggttaatctttgcctttaacaccagggttccttgggtgaaggagcttctttatcttggtaacagcattatttcaagcataacttgtaatatagttatattacatatataacatatatatatataacataacatatataacatatataacaagcataacttgttatatagtcttgtatatagtaagacctcaataaatatttggagaacaaa

SEQ ID NO: 111021 - DNA, 551 bp, Homo sapiens
  Payload ID: 1778
  Gene Symbol: BAG1
  Gene Name: BCL2-associated athanogene
  ENST ID: ENST00000473464
  CDS Start-End: 1-192
gatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagagatggggtttcaccatgttggccagactggtctcaaactcctgacctcaagtgatctgcccgcctcggcctcccaaagtgctgggattacaggcatgagccactgcgcccggcctatatgtttgtgttttaattacagaatacatgctgactgtacaaaagttttaagtacatgtataggcactaatatggaaaataaaaattacccatggggcaccaactcagagatgacgattaccaaagcctgaaatatatttttcatcttaaaaaaatttgatataatgttatttacactttataaactattcttttattggataaaaaattaaacattttcctgtgatggtatttttcaaagctcgcatgcatttcatcttgtataaatgtattatttacctagccaa

SEQ ID NO: 111022 - DNA, 6651 bp, Homo sapiens
  Payload ID: 1779
  Gene Symbol: BAG2
  Gene Name: BCL2-associated athanogene 2
  Uniprot ID: O95816
  ENST ID: ENST00000370693
  CDS Start-End: 373-1008
agacgatccgctagccacattaggcgctcggtctctgcgtccgcccctcccgtgcctcagagacttgcgctccccaggcccgagcccctgtcggcccatcctcgagcccgtgtggctcgcgaacctctaactccagccgctgcagccccctcccaggcccggcgtccccgagccccgcgggcgccgcgcctgcccttctttggctacgctgcagccgcggtgtcggcgagtcctcccgggttgcccccgcgggcgtcagagggagggcgggcgcccgcgtggtgacggcgacgcctgcagcccaaggagcgctccactcgctgccgccggaggggccggtgacctcttggctaccccgcgtcggaggcttagatggctcaggcgaagatcaacgctaaagccaacgaggggcgcttctgccgctcctcctccatggctgaccgctccagccgcctgctggagagcctggaccagctggagctcagggttgaagctttgagagaagcagcaactgctgttgagcaagagaaagaaatccttctggaaatgatccacagtatccaaaatagccaggacatgaggcagatcagtgacggagaaagagaagaattaaatctgactgcaaaccgtttgatgggaagaactctcaccgttgaagtgtcagtagaaacaattagaaacccccagcagcaagaatccctaaagcatgccacaaggattattgatgaggtggtcaataagtttctggatgatttgggaaatgccaagagtcatttaatgtcgctctacagtgcatgttcatctgaggtgccacatgggccagttgatcagaagtttcaatccatagtaattggctgtgctcttgaagatcagaagaaaattaagagaagattagagactctgcttagaaatattgaaaactctgacaaggccatcaagctattagagcattctaaaggagctggttccaaaactctgcaacaaaatgctgaaagcagattcaattagtcttcaaacctaagagcatttacacaatacacaaggtgtaaaaatgataaaatactattttaattgataactagttctttgttaggtataaccacttagttgacactgatagttgtttcagatgaggaaaatattccatcaagtatcttcagttttgtgaataacaaaactagcaatattttaattatctatctagagattttttagattgaattcttgtcttgtactaggatctagcatatttcactattctgtggatgaatacatagtttgtggggaaaacaaacgttcagctaggggcaaaaagcatgactgctttttcctgtctggcatggaatcacgcagtcaccttgggcatttagtttactagaaattctttaccttaagcagcacacacatttactacacacacagtgttaacaaagcactgtgcttagagggtaaaaaggaatcacaaaacaagaatctttccaaagttgtctcattcagcaatgttaaggcatctgtatcaaattattttggatgtaaagattcctgtgtctcataatatgaatgtattttttgatatacaagaaactgacataaaatgtgagaaaaccacctataatttaccactgtgaacaattatatatctatctgcttcatcttttctcaaatgcatcaattctctaaaattcctatattgtaacttgcctttttttaaaaaagttagatgctgatataaagtctgcttaattgtcaacttaatgagctctattttgtgtagttatatctttatccattcctcttttatggacatttaggttgtttccaacttgttgctattactgcaacatatttttgtacacaggactttttccttctttcatttttgtttttctctgtataaaggcccagcagtgaattatattgggtcaaaggatatagacgttttcatggcctcacacatattaaactttttttgtataaaggttacagcaatttatacttttttcagtaattaaaatatagctatttcactgaaatatttccagcactgagcattaatacctagtttgcattttgtttactaaaaaggttgaccagtgtgttgattcttcttttatctgataaagtgtgaagcaactagagaacacttatttgttcaaagtaactagtcctattgatatacaaaaaccacaacaacttccctggatactattttgaaatgaacacatcaatttttatttgaatgtaggtattcttcacactgaaaaaccaaatcaagatccaaactgactttatgtatgtatatatctctcaatgcaagcaatatcaaacttcattttctctacaaaaatgccaagttagtctctttataaaaagcagttacaatctgaagacattcatgttacttcctttgccagctccaactctgccttatttaaatctttgcatttcatgggaaacattaattctatctatggcagagccacttggtttgttagcagactgatttgctgtcatcagactgtgagatgattttttgtgtgcatcatttttttcttgaccagctttttgaaaattaagaaatggatagtcatgttttcttcaggttctcaagtattgtcagcatccgtaaatcccttccactctgggaaatactactgctccctgcttcccatggcttccacatcagtccaggactttttctacacaaattattctggctctgcctccttgaccttggtattcttagcattatttttcccatttttttgcaatggagtttttaatggaggtcattgatttctgatcacagacttgaagagctatgatccacatttccaagctgcttggggtccctggtttacagtgtctccagcattctgtacctagagccacatctaaagggcagggaatctccagtgtggttttttgtttttttgttttttgttttggagtcttgctctgtcacccaggctgtctgacaagtagaagacatatccactgtagcaaggaacactatggagtatatgagttagggaaaagagactgtgaagggaagagaacaaacattttgtagacgtttggtgttgaatatatgctatggaggcagtttctatagtttcatttacttcatgaggtttcattttttcttttctgagatggagtcttgctctgttgcccaggctggagtgcagtggtgtgatctcagctcactgcaacctccacctcccgggttcaagcgattctcctgcctcagcctccctagtagttgggactacaggcgcccaccaccacgcccggctaaatttttgtatttttagtagacatggggtttcaccatattggccaggctggtctcaaactcctgaccttgtgatctgcctgccttggcctcccaaagtacagggattacaggcatgagccaccacgcttggccaatgggttggttcttaacatgtatttttatttataagaatgggagtataatttattttcaaatgatgatgaatctcctgagtcacatttttaccctcatttaaactattgtcttttatatagactataagtggatatagagtatgttttgctgtatctcaattctctaccattcctagcatataatacataattttagggtagccctcctgccattccttgttagcactactttcaataaaatgagagtattaaatattggcagagtatctgaaatatgaaataattttaggttgctttgatctttaaagaagttgcattatatattttactatttagatccacactgttgatacaatcatacatatcacacaaaattttagctttgaaatgcatttattttctgattattggaattcatccttcatgaaatttttagagtagtgttttaaattaagctccagagtgtaactgcaaccaaatagcaatacatacaagtggttttccattcaaatttacaaaagcattatttattagtaataaaaatatagaaggaattcagttttccttttatccccaattttttgcttttaaaagaccatttactaacatcctactgtagatatttcgagagacagatgaaaataataataataaagattattatagccaaatcatccagttagccaggagtttgatgactggatatttcagagtctactgcgggttttaaatattttgttagcaaatgaattcatctgtatgatgagagacttacatgttttatagctgaaaacctaaggagtgacaatagtacatgtgacattcttaacagttaaaaactgagtaagtcctgttcattaggtaggtgccatgtggaacaagctttcacctcatcaatgcattttgttttcagagaaacagactaatgatagattaatgggaacattttatcaggttagcagtaactatttcaaaggttttgaaaagtatgctaataattaacaatatcttatattaaaagggtccaacactaagttgggacattaggtcctaaggccaactccctattctaaggtcttcagaaaaggtccagtttcctaaaactcacaggtccaaggagtacatgttatttattgagagttccttctgagcactgcactgccaacttctaaagcaaccacctagaacttcactccataatgaggaaaaagttttcatcctctttttggtagttttagctttattttgaaaaagtaacgtgtgctatcaactttgggcagatacaaaggaaatcatttaacctggttttatttaactatattgccttatatgggtcattctatatactatttaattcatagacagagactggaaaaggaaaaggaaacctgaggaactctgaaatatggcagttattccacagcgatatgtctacgcaaaagattagccgtaatgttaaaaaagtagattagagcacaaatgcacaatcacctggaatcttggaaaagtttttctttagtatacatggtttcataaaattaaagttatttaagagaatgaagggtcttggaaaaaaaatgtcaatttttgaaggctttaagaattgattaaattgagaaattaacatggctgactttcaggcctacttaattattttaaatgactaattatggttaggtttaaaatacagcagtgcaaattaaaaattcaaatatgtaacaaagctctctcttcagttcttatttaaaaaaagataaaactaggtacataaaattatattacaggaactgtaactatcctcagagattactttttttaaatatagaaaggtaacacgcttttagccacacagctaacatgaaaaagaactaactagaacacatataacaagtgatttttctgccaataaagacaaaagactatttgttgcaaagtattattttgtgcaaaaattaaagaggagagtagagagtagaaaattgaagagagtagaaaagatgactcattagcagtatccactgtttgttaggaactgaattttgcccccaaaacctatgtcactatcagcaatgggagtggtgacaactggtgacataaaaataagcattttacattactgtgaaatagataatgccagatcatttcaatataatgaaaagcaaaaatttactttttaattttttttatttttccatctaaaatggcaaagagaacatttacttttgatcacttaacaaggacacacccaggaaatttgattttctcaacattaggaggatgaggggagtacagatggaaaaacaaaagataaaacacaaaaggagtacataaaacattgtttagtacaaataatgaaaaatgacttcatgacattttccaataaaagttatttttacagattttgcaatgctgtaaaaaccaggtatattgaaaggggttatttataggttaaaaataaagccattgatgagtgataatcagttttaacagagttcacgcaattatcttagctggaaagctactgtcccaagtgacaaaatttatgtcctgacacatgattacatattaaatcattttgtaaaagaaatgattctgtatgtgggactgacagctcttgagaaagtgctatacaaacaaggttatagaaatgttgaagtgattgataatcttaaaataccatacaaaaatgtgtaaacaaaaggatggtttagagttgcagggcattataaaatatgtaattttagttaagactaataataatatttttgtgcactttaaaaatggttagtgtaatcttgtaagttcaaagctgggttctcagtgagcagcaaaaggtgttagatgcatcaccacacttcacaggacctcctgaatgactgcagatgtgctgtgtaccttcttaaggggctttggctgaccttatgagagcaggagctcaccatgcttatgggtgactatatcaaaaagatctgcaataaggctcacctgggagatgctctagcattcaaattcctatactcctcttttatctacgctgtcagatgaaaactgcttactgcttttaaaagatataataaacaatataaattctgatagtaaagcactataaaaattaggtatgatatttttggcacaaagcactttttaaacccaagctcattttgcaaaatatatgtctagagtttatcatttgaaaataaaaacatatacacaata

SEQ ID NO: 111023 - DNA, 2571 bp, Homo sapiens
  Payload ID: 1780
  Gene Symbol: BAG3
  Gene Name: BCL2-associated athanogene 3
  Uniprot ID: O95817
  ENST ID: ENST00000369085
  CDS Start-End: 307-2034
gcggagctccgcatccaaccccgggccgcggccaacttctctggactggaccagaagtttctagccggccagttgctacctccctttatctcctccttcccctctggcagcgaggaggctatttccagacacttccacccctctctggccacgtcacccccgcctttaattcataaaggtgcccggcgccggcttcccggacacgtcggcggcggagaggggcccacggcggcggcccggccagagactcggcgcccggagccagcgccccgcacccgcgccccagcgggcagaccccaacccagcatgagcgccgccacccactcgcccatgatgcaggtggcgtccggcaacggtgaccgcgaccctttgccccccggatgggagatcaagatcgacccgcagaccggctggcccttcttcgtggaccacaacagccgcaccactacgtggaacgacccgcgcgtgccctctgagggccccaaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaa

SEQ ID NO: 111024 - DNA, 1146 bp, Homo sapiens
  Payload ID: 1780
  Gene Symbol: BAG3
  Gene Name: BCL2-associated athanogene 3
  ENST ID: ENST00000450186
  CDS Start-End: 171-1146
tcatgtggcacatgtgataccatgtgaggtatctggtgttactaagtcgtcacgtatttcgatgaagggtccacaggctcagaaaagatggaacgagtgactgtggagaagggtagaacatgggcctgcccagagcgcgaaggcagatacagaagagctgcccgtgaaggatgcaggagactccatcctctgccaatggcccttcccgggagggctctaggctgccgcctgctagggaaggccaccctgtgtacccccagctccgaccaggctacattcccattcctgtgctccatgaaggcgctgagaaccggcaggtgcaccctttccatgtctatccccagcctgggatgcagcgattccgaactgaggcggcagcagcggctcctcagaggtcccagtcacctctgcggggcatgccagaaaccactcagccagataaacagtgtggacaggtggcagcggcggcggcagcccagcccccagcctcccacggacctgagcggtcccagtctccagctgcctctgactgctcatcctcatcctcctcggccagcctgccttcctccggcaggagcagcctgggcagtcaccagctcccgcgggggtacatctccattccggtgatacacgagcagaacgttacccggccagcagcccagccctccttccaccaagcccagaagacgcactacccagcgcagcagggggagtaccagacccaccagcctgtgtaccacaagatccagggggatgactgggagccccggcccctgcgggcggcatccccgttcaggtcatctgtccagggtgcatcgagccgggagggctcaccagccaggagcagcacgccactccactccccctcgcccatccgtgtgcacaccgtggtcgacaggcctcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccct

SEQ ID NO: 111025 - DNA, 4453 bp, Homo sapiens
  Payload ID: 1781
  Gene Symbol: BAG4
  Gene Name: BCL2-associated athanogene 4
  Uniprot ID: O95429
  ENST ID: ENST00000287322
  CDS Start-End: 272-1645
aactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggagcagccaccatatcctagctacaattctaactattggaattctactgcgagatctagggctccttacccaagtacatatcctgtaagaccagaattgcaaggccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaa

SEQ ID NO: 111026 - DNA, 1943 bp, Homo sapiens
  Payload ID: 1781
  Gene Symbol: BAG4
  Gene Name: BCL2-associated athanogene 4
  Uniprot ID: O95429
  ENST ID: ENST00000432471
  CDS Start-End: 283-1548
aggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatat

SEQ ID NO: 111027 - DNA, 719 bp, Homo sapiens
  Payload ID: 1781
  Gene Symbol: BAG4
  Gene Name: BCL2-associated athanogene 4
  ENST ID: ENST00000521311
  CDS Start-End: 1-468
gcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggtaggagacctaaatgttgttcctttaatgtgtgtgtaattaggagaacataacatggtttatatagtttctgtactggtttgtgttaaatggggactaattacaaaaagttggtgactacttatctatagctttacctcagctcggtttcctttttcttttttttaatagactttatatttagagaagatttagattcacatcgtttttgttaaaagacagaaagatacacattttctgtttgttgtaattcttctaaacgttaaatgcaaagatgcattttactactt

SEQ ID NO: 111028 - DNA, 4848 bp, Homo sapiens
  Payload ID: 1782
  Gene Symbol: BAG5
  Gene Name: BCL2-associated athanogene 5
  Uniprot ID: Q9UL15
  ENST ID: ENST00000299204
  CDS Start-End: 228-1571
cggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaaggc

SEQ ID NO: 111029 - DNA, 1960 bp, Homo sapiens
  Payload ID: 1782
  Gene Symbol: BAG5
  Gene Name: BCL2-associated athanogene 5
  Uniprot ID: Q9UL15
  ENST ID: ENST00000337322
  CDS Start-End: 292-1758
gggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttgggtaaagggccaagagggaagggcgaggcggggaggaagcagctcgggccgccttccctccgtggcctccaggacatccgccggggatagattatgcgtttccattggttacccaccttgagcgagccgtttgatagaaaccaagagcttgaaacgtgcattaggccattgtggactcccagtgggagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcatta

SEQ ID NO: 111030 - DNA, 4867 bp, Homo sapiens
  Payload ID: 1782
  Gene Symbol: BAG5
  Gene Name: BCL2-associated athanogene 5
  Uniprot ID: Q9UL15
  ENST ID: ENST00000445922
  CDS Start-End: 248-1591
gcaggcgcgccctggcacccgggccaagacgcccggagcggctgctgcagccagtagcggccccttcaccggctgccccgctcagacctagtcgggaggggtgcgaggcatgcagctgggggcccagctccggtgccgcaccccgtaaagggctgatcttccacctcgccacctcagccacgggacgccaagaccgcatccaattcagacttcttttggtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgagacctgcaggcacttatcctgtgtgctctcggggctgatcgctgacctggatgctctagatgtgtgcggccggacagaaatcagaaattatcggagggaggtagtagaagatatcaacaaattattgaaatatctggatttggaagaggaagcagacacaactaaagcatttgacctgagacagaatcattccattttaaaaatagaaaaggtcctcaagagaatgagagaaataaaaaatgaacttctccaagcacaaaacccttctgaattgtacctgagctccaaaacagaattgcagggtttaattggacagttggatgaggtaagtcttgaaaaaaacccctgcatccgggaagccaggagaagagcagtgatcgaggtgcaaactctgatcacatatattgacttgaaggaggcccttgagaaaagaaagctgtttgcttgtgaggagcacccatcccataaagccgtctggaacgtccttggaaacttgtctgagatccagggagaagttctttcatttgatggaaatcgaaccgataagaactacatccggctggaagagctgctcaccaagcagctgctagccctggatgctgttgatccgcagggagaagagaagtgtaaggctgccaggaaacaagctgtgaggcttgcgcagaatattctcagctatctcgacctgaaatctgatgaatgggagtactgaaataccagagatctcacttttgatactgttttgcacttcatatgtgcttctatgtatagagagctttcagttcattgatttatacgtgcatatttcagtctcagtatttatgattgaagcaaattctattcagtatctgctgcttttgatgttgcaagacaaatatcattacagcacgttaacttttccattcggatcattatctgtatgatgtggtgtggtttgtttggtttgtccttttttttgcgtttttaatcagaaaacaaaatagaggcagcttttgtagattttaaatgggttgtgcaagcattaaaatgcaggtctttcagaatctagaactaggcataaccttacataatactaggaaaattatgagaaaggggaaatttttggttaaataagagtaaggttcaaacacaagcagtacatgttctgtttcattatgctcgatagaaggcttttttttcacttataaggcctgattggtcctacccagcttaacggggtggggtttttttgtttgttcagacagtctgttcttttgtaaacatttttagttggaaaaacagcatctgcattttccccatcctctacgttttagagaggaatcttgtttttgtgtgcaacataagaaaattatgaaaactaatagccaaaaaacctttgagattgcattaaagagaagggataaaggaccagcaataataccttgtaagttgcttttgtttgtaaaatctgagcttatagttttccttagtgagtaaattcataaggatgggaacatttaaattaagttaatgggcctttaaaaaaaaaaaaaggaaacactcatacctgtagttggaggatgaatactggagacgggttaccaatgtcaggttatactaaaactaaatcagaaagtctgaatgtagcacataatggttctcttctgttgtccaaggctgtaaaatggacagccttgtcacacctccccggtgctgttttacaacgtgagggtagacgctgtcagtaacccagagggaccaggccttcctaggttttctaggcagtcagctgttaaccactcacttagtaaatgtcataactacacctgctccaggaccaatcagtgaaacctgctcggaattaaaggcttcctctgggtgcctgctgaacaactgagctcatgtcatgggcatgtggtggtttctctgttgcctgaaagagccattaaagtcagtcgtgcgtgaagcatctctcttctaaaggatgtgtatttccataaatgctttctgaggatccggtacaaaatgatttcccaaagttctgaagtgccttgagaacatgtgggtccgagtgttataacagactcctcccccgggtcaccttttgcctggtcatcctgttagagtacatctttggaaatccagggtaatattctctttcagagatgctcattgtgtaactctgtgtagggagatagtcactttaaacagctcaaagtagctagctaaaggagtagccttaaatacctaaaagatgacagaagcatagcccttaacaaatcttcagcttgtctctcagtatttcccaatcatgaaaatcccttgctatgtctttcctactagaaatgttctagaatcgctggacggtggggtcagagggcagtcggtatttaggccgtgagcttcccatactactgcaggtccaactcctggcaaccgcgggctcaaggcaggtcattggaatccacgttttggccacagtagttgtaggattgcttttctgtatcataattttagaatgctcttaaaatcttgaggaagagtttttattttttatttatttttgagatggagtctctgttgcccaggctgcagtgcagtggtgccatctcagctcactgcaacctccacctcccaggttcaagcgattctcctgcctcagccacctgagtagctgggagtacaggcatgtggcaccatgcctggctaatttttgtatttttaatagagttgagatttcaccatgatggtcaggctggtctcgaactcctgacctcgtgatccgcccgcctcggccccccaaagtgctgggattaacgggtgtgagccacggcgcccagcccaggaagagtttttaaattagagctctgtttaattataccactgggaaatcatggttacgcttcaggcatattcttccccagagtactacttacattttaaatttcattttgtaaagttaaatgtcagcattccctttaaaagtgtccattgttctttgaaagtagacgtttcagtcattcttttcaaacaagtgtttgtgtaccttttgccaagctgtgggcatcgtgtgtgagtacagggtgctcagctcttccaccgtcattttgaattgttcacatgggtaattggtcatggaaatgatcagattgaccttgattgactgtcaggcatggctttgtttctggtttcaatctgttctcgttccttgtaccggattattctactcctgcaatgaaccctgttgacaccggatttagctcttgtcggccttcgtggggagctgtttgtgttaatatgagctactgcatgtaattcttaaactgggcttgtcacattgtattgtatttttgtgatctgtaatgaaaagaatctgtactgcaagtaaaacctactccccaaaaatgtgtggctttgggtctgcattaaacgctgtagtccatgttcatgccaaaaatggctgggaacgtttgctttatttacattcagtcagcgttgctttcagatcacactttatccacacaggaaagccagtcagcctataatgaagtagttattaaaataaatgtaatgaatatgtctacaaagtatagtttagtggtttattttgctaaaatgcacatatatttgatataatttagtttgagaagttcagctagtttttctcctttgtttgactttgtcaatttctatctggtttttaagggtctgagcttagcttgtgcatgcaaggttttgggtttttttattttttttttgagcacagcttttcaccttttaatttgttgggtatttttctcttaataagagaaatattggccatcgatttttacatataatacaagtgtgtttttccagtacattggttcctgtcccctctctgtgaactgtttgagtattggaacagtatgtcttcaataattcaatgttactttgagatacatgtgttaatatacccttagttattcttgaaataaaaccagtctcttacgcttgcagtggagaaagg

SEQ ID NO: 111031 - DNA, 878 bp, Homo sapiens
  Payload ID: 1782
  Gene Symbol: BAG5
  Gene Name: BCL2-associated athanogene 5
  ENST ID: ENST00000557666
  CDS Start-End: 245-878
cggccgctccttggtcgcggtcactccaggctgcctcgctgcgccgctggcggtgggcgtggcgctgccggcggctaggcgcggacgccggaggaggtgtccccgggtttaggggtgttcggccaggggcggggctgccgggcccgggcgactgccggagctgcggaagtcgtggaagcgtcggcgacgcatcgcgcgatggcgcgggcgggacagtgcttgtgaaactgaacacaacaaaagtatggatatgggaaaccaacatccttctattagtaggcttcaggaaatccaaaaggaagtaaaaagtgtagaacagcaagttatcggcttcagtggtctgtcagatgacaagaattacaagaaactggagaggattctaacaaaacagctttttgaaatagactctgtagatactgaaggaaaaggagatattcagcaagctaggaagcgggcagcacaggagacagaacgtcttctcaaagagttggagcagaatgcaaaccacccacaccggattgaaatacagaacatttttgaggaagcccagtccctcgtgagagagaaaattgtgccattttataatggaggcaactgcgtaactgatgagtttgaagaaggcatccaagatatcattctgaggctgacacatgttaaaactggaggaaaaatctccttgcggaaagcaaggtatcacactttaaccaaaatctgtgcggtgcaagagataatcgaagactgcatgaaaaagcagccttccctgccgctttccgaggatgcacatccttccgttgccaaaatcaacttcgtgatgtgtgaggtgaacaaggcccgaggggtcctgattgcacttctgatgggtgtgaacaacaatgaga

SEQ ID NO: 111032 - DNA, 3779 bp, Homo sapiens
  Payload ID: 1783
  Gene Symbol: BAG6
  Gene Name: BCL2-associated athanogene 6
  Uniprot ID: P46379
  ENST ID: ENST00000211379
  CDS Start-End: 296-3676
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111033 - DNA, 3755 bp, Homo sapiens
  Payload ID: 1783
  Gene Symbol: BAG6
  Gene Name: BCL2-associated athanogene 6
  Uniprot ID: P46379
  ENST ID: ENST00000361076
  CDS Start-End: 250-3648
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111034 - DNA, 3626 bp, Homo sapiens
  Payload ID: 1783
  Gene Symbol: BAG6
  Gene Name: BCL2-associated athanogene 6
  Uniprot ID: P46379
  ENST ID: ENST00000362049
  CDS Start-End: 291-3524
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 111035 - DNA, 3815 bp, Homo sapiens
  Payload ID: 1783
  Gene Symbol: BAG6
  Gene Name: BCL2-associated athanogene 6
  Uniprot ID: P46379
  ENST ID: ENST00000375964
  CDS Start-End: 315-3713
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 111036 - DNA, 3644 bp, Homo sapiens
  Payload ID: 1783
  Gene Symbol: BAG6
  Gene Name: BCL2-associated athanogene 6
  Uniprot ID: P46379
  ENST ID: ENST00000375976
  CDS Start-End: 161-3541
ggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111037 - DNA, 3656 bp, Homo sapiens
  Payload ID: 1783
  Gene Symbol: BAG6
  Gene Name: BCL2-associated athanogene 6
  Uniprot ID: P46379
  ENST ID: ENST00000383446
  CDS Start-End: 169-3549
ggggaagtcgggggcggagccgcggggtggtgggtgggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111038 - DNA, 3783 bp, Homo sapiens
  Payload ID: 1783
  Gene Symbol: BAG6
  Gene Name: BCL2-associated athanogene 6
  Uniprot ID: P46379
  ENST ID: ENST00000383448
  CDS Start-End: 296-3676
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111039 - DNA, 902 bp, Homo sapiens
  Payload ID: 1783
  Gene Symbol: BAG6
  Gene Name: BCL2-associated athanogene 6
  ENST ID: ENST00000425373
  CDS Start-End: 124-902
tccctaagccgtcgatctcctgccctttgtgtttctctccctgtgccccggaatcagaagggggatggggacaggtgtgaatgtgtgtgtgtgcaggagaaactttttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaa

SEQ ID NO: 111040 - DNA, 902 bp, Homo sapiens; identical to SEQ ID NO: 111039
  Payload ID: 1783
  Gene Symbol: BAG6
  Gene Name: BCL2-associated athanogene 6
  ENST ID: ENST00000446325
  CDS Start-End: 124-902

SEQ ID NO: 111041 - DNA, 902 bp, Homo sapiens; identical to SEQ ID NO: 111039
  Payload ID: 1783
  Gene Symbol: BAG6
  Gene Name: BCL2-associated athanogene 6
  ENST ID: ENST00000433828
  CDS Start-End: 124-902

SEQ ID NO: 111042 - DNA, 807 bp, Homo sapiens
  Payload ID: 1783
  Gene Symbol: BAG6
  Gene Name: BCL2-associated athanogene 6
  ENST ID: ENST00000424003
  CDS Start-End: 217-807
cagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccctccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 111043 - DNA, 714 bp, Homo sapiens
  Payload ID: 1783
  Gene Symbol: BAG6
  Gene Name: BCL2-associated athanogene 6
  ENST ID: ENST00000419635
  CDS Start-End: 1-714
tcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttg

SEQ ID NO: 111044 - DNA, 2407 bp, Homo sapiens
  Payload ID: 1783
  Gene Symbol: BAG6
  Gene Name: BCL2-associated athanogene 6
  ENST ID: ENST00000415170
  CDS Start-End: 180-2407
cgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgct

SEQ ID NO: 111045 - DNA, 3783 bp, Homo sapiens; identical to SEQ ID NO: 111038
  Payload ID: 1783
  Gene Symbol: BAG6
  Gene Name: BCL2-associated athanogene 6
  Uniprot ID: P46379
  ENST ID: ENST00000419847
  CDS Start-End: 296-3676

SEQ ID NO: 111046 - DNA, 1056 bp, Homo sapiens
  Payload ID: 1783
  Gene Symbol: BAG6
  Gene Name: BCL2-associated athanogene 6
  ENST ID: ENST00000441994
  CDS Start-End: 282-1056
tgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaa

SEQ ID NO: 111047 - DNA, 654 bp, Homo sapiens
  Payload ID: 1783
  Gene Symbol: BAG6
  Gene Name: BCL2-associated athanogene 6
  ENST ID: ENST00000431989
  CDS Start-End: 36-654
cggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctcccc

SEQ ID NO: 111048 - DNA, 544 bp, Homo sapiens
  Payload ID: 1783
  Gene Symbol: BAG6
  Gene Name: BCL2-associated athanogene 6
  ENST ID: ENST00000442112
  CDS Start-End: 69-544
tttccgacctctggggcgcttgtcctgccgtgaccggtgatgacactagtctctgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattca

SEQ ID NO: 111049 - DNA, 2407 bp, Homo sapiens
  Payload ID: 1783
  Gene Symbol: BAG6
  Gene Name: BCL2-associated athanogene 6
  ENST ID: ENST00000436569
  CDS Start-End: 180-2407
cgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctccgcggccgcaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgct

SEQ ID NO: 111050 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000458287
  CDS Start-End: 282-1056

SEQ ID NO: 111051 - DNA, 3755 bp, Homo sapiens; identical to SEQ ID NO: 111033
  Payload ID: 1783
  Gene Symbol: BAG6
  Gene Name: BCL2-associated athanogene 6
  Uniprot ID: P46379
  ENST ID: ENST00000451932
  CDS Start-End: 250-3648

SEQ ID NO: 111052 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000437731
  CDS Start-End: 69-544

SEQ ID NO: 111053 - DNA, 844 bp, Homo sapiens
  Payload ID: 1783
  Gene Symbol: BAG6
  Gene Name: BCL2-associated athanogene 6
  ENST ID: ENST00000421991
  CDS Start-End: 147-844
cggtcccccgggcgacagcggtggcggctcctcggggtgctcggctccctcccacctaggccggccccggcccgactcgccctcagaaactcactgtttggggctgcggactttctcgtcgtgccccacaaaaagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcc

SEQ ID NO: 111054 - DNA, 554 bp, Homo sapiens
  Payload ID: 1783
  Gene Symbol: BAG6
  Gene Name: BCL2-associated athanogene 6
  ENST ID: ENST00000423612
  CDS Start-End: 1-554
tctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaaggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctc

SEQ ID NO: 111055 - DNA, 993 bp, Homo sapiens
  Payload ID: 1783
  Gene Symbol: BAG6
  Gene Name: BCL2-associated athanogene 6
  ENST ID: ENST00000451898
  CDS Start-End: 263-993
gtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacc

SEQ ID NO: 111056 - DNA, 680 bp, Homo sapiens
  Payload ID: 1783
  Gene Symbol: BAG6
  Gene Name: BCL2-associated athanogene 6
  ENST ID: ENST00000419496
  CDS Start-End: 1-680
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttag

SEQ ID NO: 111057 - DNA, 807 bp, Homo sapiens; identical to SEQ ID NO: 111042
  Payload ID: 1783
  Gene Symbol: BAG6
  Gene Name: BCL2-associated athanogene 6
  ENST ID: ENST00000426331
  CDS Start-End: 217-807

SEQ ID NO: 111058 - DNA, 747 bp, Homo sapiens
  Payload ID: 1783
  Gene Symbol: BAG6
  Gene Name: BCL2-associated athanogene 6
  ENST ID: ENST00000424176
  CDS Start-End: 103-747
tgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtg

SEQ ID NO: 111059 - DNA, 513 bp, Homo sapiens
  Payload ID: 1783
  Gene Symbol: BAG6
  Gene Name: BCL2-associated athanogene 6
  ENST ID: ENST00000434874
  CDS Start-End: 1-410
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111060 - DNA, 747 bp, Homo sapiens; identical to SEQ ID NO: 111058
  Payload ID: 1783
  Gene Symbol: BAG6
  Gene Name: BCL2-associated athanogene 6
  ENST ID: ENST00000436859
  CDS Start-End: 103-747

SEQ ID NO: 111061 - DNA, 844 bp, Homo sapiens; identical to SEQ ID NO: 111053
  Payload ID: 1783
  Gene Symbol: BAG6
  Gene Name: BCL2-associated athanogene 6
  ENST ID: ENST00000444557
  CDS Start-End: 147-844

SEQ ID NO: 111062 - DNA, 714 bp, Homo sapiens
  Payload ID: 1783
  Gene Symbol: BAG6
  Gene Name: BCL2-associated athanogene 6
  ENST ID: ENST00000417468
  CDS Start-End: 1-714
tcctcagctgagggggctcccccgccaggtccagctcccccgccagccaccagccacccgagggtcatccggatttcccaccagagtgtggaacccgtggtcatgatgcacatgaacattcaagggccactgtctctgtctccctgcccagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttg

SEQ ID NO: 111063 - DNA, 410 bp, Homo sapiens
  Payload ID: 1783
  Gene Symbol: BAG6
  Gene Name: BCL2-associated athanogene 6
  ENST ID: ENST00000415721
  CDS Start-End: 1-410
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttag

SEQ ID NO: 111064 - DNA, 766 bp, Homo sapiens
  Payload ID: 1783
  Gene Symbol: BAG6
  Gene Name: BCL2-associated athanogene 6
  ENST ID: ENST00000451534
  CDS Start-End: 33-766
agaagggggatggggacagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 111065 - DNA, 880 bp, Homo sapiens
  Payload ID: 1783
  Gene Symbol: BAG6
  Gene Name: BCL2-associated athanogene 6
  ENST ID: ENST00000422860
  CDS Start-End: 93-880
cgcagagtgtggggcgaccaccgctttcgcgttgtcccaggattttccgacctctggggcgcttgtcctgccgtgaccgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 111066 - DNA, 902 bp, Homo sapiens; identical to SEQ ID NO: 111039
  Payload ID: 1783
  Gene Symbol: BAG6
  Gene Name: BCL2-associated athanogene 6
  ENST ID: ENST00000431345
  CDS Start-End: 124-902

SEQ ID NO: 111067 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000442698
  CDS Start-End: 263-993

SEQ ID NO: 111068 - DNA, 902 bp, Homo sapiens; identical to SEQ ID NO: 111039
  Payload ID: 1783
  Gene Symbol: BAG6
  Gene Name: BCL2-associated athanogene 6
  ENST ID: ENST00000441898
  CDS Start-End: 124-902

SEQ ID NO: 111069 - DNA, 859 bp, Homo sapiens
  Payload ID: 1783
  Gene Symbol: BAG6
  Gene Name: BCL2-associated athanogene 6
  ENST ID: ENST00000453772
  CDS Start-End: 126-859
gtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 111070 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000449173
  CDS Start-End: 263-993

SEQ ID NO: 111071 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000420075
  CDS Start-End: 93-880

SEQ ID NO: 111072 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000416852
  CDS Start-End: 33-766

SEQ ID NO: 111073 - DNA, 783 bp, Homo sapiens
  Payload ID: 1783
  Gene Symbol: BAG6
  Gene Name: BCL2-associated athanogene 6
  ENST ID: ENST00000423989
  CDS Start-End: 1-680
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111074 - DNA, 3779 bp, Homo sapiens
  Payload ID: 1783
  Gene Symbol: BAG6
  Gene Name: BCL2-associated athanogene 6
  ENST ID: ENST00000434446
  CDS Start-End: 296-3676
gggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111075 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000434444
  CDS Start-End: 33-766

SEQ ID NO: 111076 - DNA, 747 bp, Homo sapiens
  Payload ID: 1783
  Gene Symbol: BAG6
  Gene Name: BCL2-associated athanogene 6
  ENST ID: ENST00000434880
  CDS Start-End: 103-747
tgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtg

SEQ ID NO: 111077 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000416797
  CDS Start-End: 36-654

SEQ ID NO: 111078 - DNA, 714 bp, Homo sapiens; identical to SEQ ID NO: 111043
  Payload ID: 1783
  Gene Symbol: BAG6
  Gene Name: BCL2-associated athanogene 6
  ENST ID: ENST00000413373
  CDS Start-End: 1-714

SEQ ID NO: 111079 - DNA, 1710 bp, Homo sapiens
  Payload ID: 1783
  Gene Symbol: BAG6
  Gene Name: BCL2-associated athanogene 6
  ENST ID: ENST00000421354
  CDS Start-End: 166-1710
tcgggggcggagccgcggggtggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111080 - DNA, 714 bp, Homo sapiens; identical to SEQ ID NO: 111062
  Payload ID: 1783
  Gene Symbol: BAG6
  Gene Name: BCL2-associated athanogene 6
  ENST ID: ENST00000455101
  CDS Start-End: 1-714

SEQ ID NO: 111081 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000454165
  CDS Start-End: 69-544

SEQ ID NO: 111082 - DNA, 736 bp, Homo sapiens
  Payload ID: 1783
  Gene Symbol: BAG6
  Gene Name: BCL2-associated athanogene 6
  ENST ID: ENST00000435543
  CDS Start-End: 1-736
cccccacgacacctgcatgtggtccggcctatgtctcactacaccacccccatggtgctccagcaggcagccattcccatacagatcaatgtgggaaccactgtgaccatgacaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctg

SEQ ID NO: 111083 - DNA, 736 bp, Homo sapiens
  Payload ID: 1783
  Gene Symbol: BAG6
  Gene Name: BCL2-associated athanogene 6
  ENST ID: ENST00000456828
  CDS Start-End: 1-736
cccccacgacacctgcatgtggtccggcctatgtctcactacaccacccccatggtgctccagcaggcagccattcccatacagatcaatgtgggaaccactgtgaccatgacaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctg

SEQ ID NO: 111084 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000429956
  CDS Start-End: 33-766

SEQ ID NO: 111085 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000439917
  CDS Start-End: 1-554

SEQ ID NO: 111086 - DNA, 3755 bp, Homo sapiens; identical to SEQ ID NO: 111033
  Payload ID: 1783
  Gene Symbol: BAG6
  Gene Name: BCL2-associated athanogene 6
  Uniprot ID: P46379
  ENST ID: ENST00000449450
  CDS Start-End: 250-3648

SEQ ID NO: 111087 - DNA, 902 bp, Homo sapiens; identical to SEQ ID NO: 111039
  Payload ID: 1783
  Gene Symbol: BAG6
  Gene Name: BCL2-associated athanogene 6
  ENST ID: ENST00000437054
  CDS Start-End: 124-902

SEQ ID NO: 111088 - DNA, 2407 bp, Homo sapiens; identical to SEQ ID NO: 111049
  Payload ID: 1783
  Gene Symbol: BAG6
  Gene Name: BCL2-associated athanogene 6
  ENST ID: ENST00000437771
  CDS Start-End: 180-2407

SEQ ID NO: 111089 - DNA, 736 bp, Homo sapiens; identical to SEQ ID NO: 111082
  Payload ID: 1783
  Gene Symbol: BAG6
  Gene Name: BCL2-associated athanogene 6
  ENST ID: ENST00000451948
  CDS Start-End: 1-736

SEQ ID NO: 111090 - DNA, 787 bp, Homo sapiens
  Payload ID: 1783
  Gene Symbol: BAG6
  Gene Name: BCL2-associated athanogene 6
  ENST ID: ENST00000437959
  CDS Start-End: 1-680
atagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111091 - DNA, 1051 bp, Homo sapiens
  Payload ID: 1783
  Gene Symbol: BAG6
  Gene Name: BCL2-associated athanogene 6
  ENST ID: ENST00000440499
  CDS Start-End: 266-1051
agtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcaccc

SEQ ID NO: 111092 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000430999
  CDS Start-End: 36-654

SEQ ID NO: 111093 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000455689
  CDS Start-End: 1-554

SEQ ID NO: 111094 - DNA, 1689 bp, Homo sapiens
  Payload ID: 1783
  Gene Symbol: BAG6
  Gene Name: BCL2-associated athanogene 6
  ENST ID: ENST00000432539
  CDS Start-End: 145-1689
ggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111095 - DNA, 2407 bp, Homo sapiens; identical to SEQ ID NO: 111049
  Payload ID: 1783
  Gene Symbol: BAG6
  Gene Name: BCL2-associated athanogene 6
  ENST ID: ENST00000425568
  CDS Start-End: 180-2407

SEQ ID NO: 111096 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000436497
  CDS Start-End: 266-1051

SEQ ID NO: 111097 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000455409
  CDS Start-End: 36-654

SEQ ID NO: 111098 - DNA, 859 bp, Homo sapiens; identical to SEQ ID NO: 111069
  Payload ID: 1783
  Gene Symbol: BAG6
  Gene Name: BCL2-associated athanogene 6
  ENST ID: ENST00000427244
  CDS Start-End: 126-859

SEQ ID NO: 111099 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000433146
  CDS Start-End: 69-544

SEQ ID NO: 111100 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000420098
  CDS Start-End: 69-544

SEQ ID NO: 111101 - DNA, 859 bp, Homo sapiens; identical to SEQ ID NO: 111069
  Payload ID: 1783
  Gene Symbol: BAG6
  Gene Name: BCL2-associated athanogene 6
  ENST ID: ENST00000456622
  CDS Start-End: 126-859

SEQ ID NO: 111102 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000454248
  CDS Start-End: 36-654

SEQ ID NO: 111103 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000456223
  CDS Start-End: 266-1051

SEQ ID NO: 111104 - DNA, 736 bp, Homo sapiens; identical to SEQ ID NO: 111083
  Payload ID: 1783
  Gene Symbol: BAG6
  Gene Name: BCL2-associated athanogene 6
  ENST ID: ENST00000411914
  CDS Start-End: 1-736

SEQ ID NO: 111105 - DNA, 2407 bp, Homo sapiens; identical to SEQ ID NO: 111044
  Payload ID: 1783
  Gene Symbol: BAG6
  Gene Name: BCL2-associated athanogene 6
  ENST ID: ENST00000451042
  CDS Start-End: 180-2407

SEQ ID NO: 111106 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000452627
  CDS Start-End: 282-1056

SEQ ID NO: 111107 - DNA, 3104 bp, Homo sapiens
  Payload ID: 1783
  Gene Symbol: BAG6
  Gene Name: BCL2-associated athanogene 6
  Uniprot ID: P46379
  ENST ID: ENST00000439687
  CDS Start-End: 291-3002
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgggcgccggtctgggtaccaatgcctcgttggcccagatggtgagcggccttgtggggcagcttcttatgcagccagtccttgtggctcaggggaccccagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 111108 - DNA, 1689 bp, Homo sapiens
  Payload ID: 1783
  Gene Symbol: BAG6
  Gene Name: BCL2-associated athanogene 6
  ENST ID: ENST00000449874
  CDS Start-End: 145-1689
ggtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111109 - DNA, 859 bp, Homo sapiens; identical to SEQ ID NO: 111069
  Payload ID: 1783
  Gene Symbol: BAG6
  Gene Name: BCL2-associated athanogene 6
  ENST ID: ENST00000431049
  CDS Start-End: 126-859

SEQ ID NO: 111110 - DNA, 1688 bp, Homo sapiens
  Payload ID: 1783
  Gene Symbol: BAG6
  Gene Name: BCL2-associated athanogene 6
  ENST ID: ENST00000442870
  CDS Start-End: 144-1688
gtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111111 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000436807
  CDS Start-End: 282-1056

SEQ ID NO: 111112 - DNA, 1714 bp, Homo sapiens
  Payload ID: 1783
  Gene Symbol: BAG6
  Gene Name: BCL2-associated athanogene 6
  ENST ID: ENST00000428037
  CDS Start-End: 170-1714
tcgggggcggagccgcggggtggtgggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111113 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000428905
  CDS Start-End: 93-880

SEQ ID NO: 111114 - DNA, 3635 bp, Homo sapiens
  Payload ID: 1783
  Gene Symbol: BAG6
  Gene Name: BCL2-associated athanogene 6
  ENST ID: ENST00000413922
  CDS Start-End: 152-3532
ggagccgcggggtggtgggtgtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111115 - DNA, 1710 bp, Homo sapiens
  Payload ID: 1783
  Gene Symbol: BAG6
  Gene Name: BCL2-associated athanogene 6
  ENST ID: ENST00000447656
  CDS Start-End: 166-1710
tcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcaggtctgtcgccccagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggctccaccctcatccagctgccctccctgccccctgagttcatgcacgccgtcgcccaccagatcactcatcaggccatggtggcagctgttgcctcc

SEQ ID NO: 111116 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000419409
  CDS Start-End: 69-544

SEQ ID NO: 111117 - DNA, 747 bp, Homo sapiens; identical to SEQ ID NO: 111058
  Payload ID: 1783
  Gene Symbol: BAG6
  Gene Name: BCL2-associated athanogene 6
  ENST ID: ENST00000432814
  CDS Start-End: 103-747

SEQ ID NO: 111118 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000415034
  CDS Start-End: 93-880

SEQ ID NO: 111119 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000452994
  CDS Start-End: 93-880

SEQ ID NO: 111120 - DNA, 807 bp, Homo sapiens; identical to SEQ ID NO: 111042
  Payload ID: 1783
  Gene Symbol: BAG6
  Gene Name: BCL2-associated athanogene 6
  ENST ID: ENST00000438112
  CDS Start-End: 217-807

SEQ ID NO: 111121 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000450513
  CDS Start-End: 263-993

SEQ ID NO: 111122 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000445519
  CDS Start-End: 1-554

SEQ ID NO: 111123 - DNA, 2407 bp, Homo sapiens; identical to SEQ ID NO: 111049
  Payload ID: 1783
  Gene Symbol: BAG6
  Gene Name: BCL2-associated athanogene 6
  ENST ID: ENST00000418840
  CDS Start-End: 180-2407

SEQ ID NO: 111124 - DNA, 902 bp, Homo sapiens
  Payload ID: 1783
  Gene Symbol: BAG6
  Gene Name: BCL2-associated athanogene 6
  ENST ID: ENST00000453928
  CDS Start-End: 124-902
tccctaagccgtcgatctcctgccctttgtgtttctctccctgtgccccggaatcagaagggggatggggacaggtgtgaatgtgtgtgtgtgcaggagatactttttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaa

SEQ ID NO: 111125 - DNA, 714 bp, Homo sapiens; identical to SEQ ID NO: 111043
  Payload ID: 1783
  Gene Symbol: BAG6
  Gene Name: BCL2-associated athanogene 6
  ENST ID: ENST00000432674
  CDS Start-End: 1-714

SEQ ID NO: 111126 - DNA, 859 bp, Homo sapiens
  Payload ID: 1783
  Gene Symbol: BAG6
  Gene Name: BCL2-associated athanogene 6
  ENST ID: ENST00000417824
  CDS Start-End: 126-859
gggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaa

SEQ ID NO: 111127 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000415770
  CDS Start-End: 266-1051

SEQ ID NO: 111128 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000441054
  CDS Start-End: 36-654

SEQ ID NO: 111129 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000417419
  CDS Start-End: 263-993

SEQ ID NO: 111130 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000453833
  CDS Start-End: 1-554

SEQ ID NO: 111131 - DNA, 807 bp, Homo sapiens
  Payload ID: 1783
  Gene Symbol: BAG6
  Gene Name: BCL2-associated athanogene 6
  ENST ID: ENST00000456286
  CDS Start-End: 217-807
cagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 111132 - DNA, 747 bp, Homo sapiens; identical to SEQ ID NO: 111076
  Payload ID: 1783
  Gene Symbol: BAG6
  Gene Name: BCL2-associated athanogene 6
  ENST ID: ENST00000414208
  CDS Start-End: 103-747

SEQ ID NO: 111133 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000442427
  CDS Start-End: 33-766

SEQ ID NO: 111134 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000420942
  CDS Start-End: 282-1056

SEQ ID NO: 111135 - DNA, 544 bp, Homo sapiens; identical to SEQ ID NO: 111048
  Payload ID: 1783
  Gene Symbol: BAG6
  Gene Name: BCL2-associated athanogene 6
  ENST ID: ENST00000447798
  CDS Start-End: 69-544

SEQ ID NO: 111136 - DNA, 844 bp, Homo sapiens; identical to SEQ ID NO: 111053
  Payload ID: 1783
  Gene Symbol: BAG6
  Gene Name: BCL2-associated athanogene 6
  ENST ID: ENST00000446133
  CDS Start-End: 147-844

SEQ ID NO: 111137 - DNA, 859 bp, Homo sapiens; identical to SEQ ID NO: 111126
  Payload ID: 1783
  Gene Symbol: BAG6
  Gene Name: BCL2-associated athanogene 6
  ENST ID: ENST00000421106
  CDS Start-End: 126-859

SEQ ID NO: 111138 - DNA, 844 bp, Homo sapiens; identical to SEQ ID NO: 111053
  Payload ID: 1783
  Gene Symbol: BAG6
  Gene Name: BCL2-associated athanogene 6
  ENST ID: ENST00000424221
  CDS Start-End: 147-844

SEQ ID NO: 111139 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000428271
  CDS Start-End: 263-993

SEQ ID NO: 111140 - DNA, 807 bp, Homo sapiens; identical to SEQ ID NO: 111131
  Payload ID: 1783
  Gene Symbol: BAG6
  Gene Name: BCL2-associated athanogene 6
  ENST ID: ENST00000416755
  CDS Start-End: 217-807

SEQ ID NO: 111141 - DNA, 410 bp, Homo sapiens; identical to SEQ ID NO: 111063
  Payload ID: 1783
  Gene Symbol: BAG6
  Gene Name: BCL2-associated athanogene 6
  ENST ID: ENST00000433960
  CDS Start-End: 1-410

SEQ ID NO: 111142 - DNA, 3648 bp, Homo sapiens
  Payload ID: 1783
  Gene Symbol: BAG6
  Gene Name: BCL2-associated athanogene 6
  ENST ID: ENST00000422756
  CDS Start-End: 165-3545
ggggaagtcgggggcggagccgcggggtggtgggtgtgtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111143 - DNA, 807 bp, Homo sapiens; identical to SEQ ID NO: 111131
  Payload ID: 1783
  Gene Symbol: BAG6
  Gene Name: BCL2-associated athanogene 6
  ENST ID: ENST00000427281
  CDS Start-End: 217-807

SEQ ID NO: 111144 - DNA, 747 bp, Homo sapiens; identical to SEQ ID NO: 111076
  Payload ID: 1783
  Gene Symbol: BAG6
  Gene Name: BCL2-associated athanogene 6
  ENST ID: ENST00000453763
  CDS Start-End: 103-747

SEQ ID NO: 111145 - DNA, 3779 bp, Homo sapiens; identical to SEQ ID NO: 111074
  Payload ID: 1783
  Gene Symbol: BAG6
  Gene Name: BCL2-associated athanogene 6
  ENST ID: ENST00000412012
  CDS Start-End: 296-3676

SEQ ID NO: 111146 - DNA, 844 bp, Homo sapiens; identical to SEQ ID NO: 111053
  Payload ID: 1783
  Gene Symbol: BAG6
  Gene Name: BCL2-associated athanogene 6
  ENST ID: ENST00000448278
  CDS Start-End: 147-844

SEQ ID NO: 111147 - DNA, 513 bp, Homo sapiens; identical to SEQ ID NO: 111059
  Payload ID: 1783
  Gene Symbol: BAG6
  Gene Name: BCL2-associated athanogene 6
  ENST ID: ENST00000443312
  CDS Start-End: 1-410

SEQ ID NO: 111148 - DNA, 517 bp, Homo sapiens
  Payload ID: 1783
  Gene Symbol: BAG6
  Gene Name: BCL2-associated athanogene 6
  ENST ID: ENST00000458596
  CDS Start-End: 1-410
gtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111149 - DNA, 2407 bp, Homo sapiens; identical to SEQ ID NO: 111044
  Payload ID: 1783
  Gene Symbol: BAG6
  Gene Name: BCL2-associated athanogene 6
  ENST ID: ENST00000438641
  CDS Start-End: 180-2407

SEQ ID NO: 111150 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000453036
  CDS Start-End: 93-880

SEQ ID NO: 111151 - DNA, 783 bp, Homo sapiens; identical to SEQ ID NO: 111073
  Payload ID: 1783
  Gene Symbol: BAG6
  Gene Name: BCL2-associated athanogene 6
  ENST ID: ENST00000457868
  CDS Start-End: 1-680

SEQ ID NO: 111152 - DNA, 859 bp, Homo sapiens; identical to SEQ ID NO: 111069
  Payload ID: 1783
  Gene Symbol: BAG6
  Gene Name: BCL2-associated athanogene 6
  ENST ID: ENST00000438330
  CDS Start-End: 126-859

SEQ ID NO: 111153 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000438546
  CDS Start-End: 266-1051

SEQ ID NO: 111154 - DNA, 3652 bp, Homo sapiens
  Payload ID: 1783
  Gene Symbol: BAG6
  Gene Name: BCL2-associated athanogene 6
  Uniprot ID: P46379
  ENST ID: ENST00000443182
  CDS Start-End: 165-3545
ggggaagtcgggggcggagccgcggggtggtgggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111155 - DNA, 747 bp, Homo sapiens; identical to SEQ ID NO: 111058
  Payload ID: 1783
  Gene Symbol: BAG6
  Gene Name: BCL2-associated athanogene 6
  ENST ID: ENST00000456067
  CDS Start-End: 103-747

SEQ ID NO: 111156 - DNA, 714 bp, Homo sapiens; identical to SEQ ID NO: 111062
  Payload ID: 1783
  Gene Symbol: BAG6
  Gene Name: BCL2-associated athanogene 6
  ENST ID: ENST00000438149
  CDS Start-End: 1-714

SEQ ID NO: 111157 - DNA, 844 bp, Homo sapiens; identical to SEQ ID NO: 111053
  Payload ID: 1783
  Gene Symbol: BAG6
  Gene Name: BCL2-associated athanogene 6
  ENST ID: ENST00000433726
  CDS Start-End: 147-844

SEQ ID NO: 111158 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000432174
  CDS Start-End: 33-766

SEQ ID NO: 111159 - DNA, 714 bp, Homo sapiens; identical to SEQ ID NO: 111062
  Payload ID: 1783
  Gene Symbol: BAG6
  Gene Name: BCL2-associated athanogene 6
  ENST ID: ENST00000429830
  CDS Start-End: 1-714

SEQ ID NO: 111160 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000424480
  CDS Start-End: 282-1056

SEQ ID NO: 111161 - DNA, 1710 bp, Homo sapiens; identical to SEQ ID NO: 111115
  Payload ID: 1783
  Gene Symbol: BAG6
  Gene Name: BCL2-associated athanogene 6
  ENST ID: ENST00000435080
  CDS Start-End: 166-1710

SEQ ID NO: 111162 - DNA, 807 bp, Homo sapiens
  Payload ID: 1783
  Gene Symbol: BAG6
  Gene Name: BCL2-associated athanogene 6
  ENST ID: ENST00000435066
  CDS Start-End: 217-807
cagctccctaagccgtcgatctcctgccctttgtgtttctctccctgtgccccggaatcagaagggggatggggacaggtgtgaatgtgtgtgtgtgcaggagatactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgccc

SEQ ID NO: 111163 - DNA, 736 bp, Homo sapiens; identical to SEQ ID NO: 111083
  Payload ID: 1783
  Gene Symbol: BAG6
  Gene Name: BCL2-associated athanogene 6
  ENST ID: ENST00000453241
  CDS Start-End: 1-736

SEQ ID NO: 111164 - DNA, 3783 bp, Homo sapiens; identical to SEQ ID NO: 111038
  Payload ID: 1783
  Gene Symbol: BAG6
  Gene Name: BCL2-associated athanogene 6
  Uniprot ID: P46379
  ENST ID: ENST00000417144
  CDS Start-End: 296-3676

SEQ ID NO: 111165 - DNA, 513 bp, Homo sapiens; identical to SEQ ID NO: 111059
  Payload ID: 1783
  Gene Symbol: BAG6
  Gene Name: BCL2-associated athanogene 6
  ENST ID: ENST00000424504
  CDS Start-End: 1-410

SEQ ID NO: 111166 - DNA, 513 bp, Homo sapiens; identical to SEQ ID NO: 111059
  Payload ID: 1783
  Gene Symbol: BAG6
  Gene Name: BCL2-associated athanogene 6
  ENST ID: ENST00000422948
  CDS Start-End: 1-410

SEQ ID NO: 111167 - DNA, 654 bp, Homo sapiens; identical to SEQ ID NO: 111047
  Payload ID: 1783
  Gene Symbol: BAG6
  Gene Name: BCL2-associated athanogene 6
  ENST ID: ENST00000437735
  CDS Start-End: 36-654

SEQ ID NO: 111168 - DNA, 3751 bp, Homo sapiens
  Payload ID: 1783
  Gene Symbol: BAG6
  Gene Name: BCL2-associated athanogene 6
  ENST ID: ENST00000444402
  CDS Start-End: 250-3648
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111169 - DNA, 3751 bp, Homo sapiens; identical to SEQ ID NO: 111168
  Payload ID: 1783
  Gene Symbol: BAG6
  Gene Name: BCL2-associated athanogene 6
  ENST ID: ENST00000425649
  CDS Start-End: 250-3648

SEQ ID NO: 111170 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000436814
  CDS Start-End: 1-554

SEQ ID NO: 111171 - DNA, 736 bp, Homo sapiens; identical to SEQ ID NO: 111082
  Payload ID: 1783
  Gene Symbol: BAG6
  Gene Name: BCL2-associated athanogene 6
  ENST ID: ENST00000445869
  CDS Start-End: 1-736

SEQ ID NO: 111172 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000428326
  CDS Start-End: 266-1051

SEQ ID NO: 111173 - DNA, 3648 bp, Homo sapiens
  Payload ID: 1783
  Gene Symbol: BAG6
  Gene Name: BCL2-associated athanogene 6
  Uniprot ID: P46379
  ENST ID: ENST00000442479
  CDS Start-End: 161-3541
ggggaagtcgggggcggagccgcggggtggtgggtgggtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctcta

SEQ ID NO: 111174 - DNA, 783 bp, Homo sapiens; identical to SEQ ID NO: 111073
  Payload ID: 1783
  Gene Symbol: BAG6
  Gene Name: BCL2-associated athanogene 6
  ENST ID: ENST00000456804
  CDS Start-End: 1-680

SEQ ID NO: 111175 - DNA, 993 bp, Homo sapiens; identical to SEQ ID NO: 111055
  Payload ID: 1783
  Gene Symbol: BAG6
  Gene Name: BCL2-associated athanogene 6
  ENST ID: ENST00000438842
  CDS Start-End: 263-993

SEQ ID NO: 111176 - DNA, 1056 bp, Homo sapiens; identical to SEQ ID NO: 111046
  Payload ID: 1783
  Gene Symbol: BAG6
  Gene Name: BCL2-associated athanogene 6
  ENST ID: ENST00000436434
  CDS Start-End: 282-1056

SEQ ID NO: 111177 - DNA, 766 bp, Homo sapiens; identical to SEQ ID NO: 111064
  Payload ID: 1783
  Gene Symbol: BAG6
  Gene Name: BCL2-associated athanogene 6
  ENST ID: ENST00000416094
  CDS Start-End: 33-766

SEQ ID NO: 111178 - DNA, 3779 bp, Homo sapiens; identical to SEQ ID NO: 111074
  Payload ID: 1783
  Gene Symbol: BAG6
  Gene Name: BCL2-associated athanogene 6
  ENST ID: ENST00000415345
  CDS Start-End: 296-3676

SEQ ID NO: 111179 - DNA, 3751 bp, Homo sapiens; identical to SEQ ID NO: 111168
  Payload ID: 1783
  Gene Symbol: BAG6
  Gene Name: BCL2-associated athanogene 6
  ENST ID: ENST00000454478
  CDS Start-End: 250-3648

SEQ ID NO: 111180 - DNA, 880 bp, Homo sapiens; identical to SEQ ID NO: 111065
  Payload ID: 1783
  Gene Symbol: BAG6
  Gene Name: BCL2-associated athanogene 6
  ENST ID: ENST00000439612
  CDS Start-End: 93-880

SEQ ID NO: 111181 - DNA, 3644 bp, Homo sapiens
  Payload ID: 1783
  Gene Symbol: BAG6
  Gene Name: BCL2-associated athanogene 6
  ENST ID: ENST00000415373
  CDS Start-End: 161-3541
ggggaagtcgggggcggagccgcggggtggtgggtgtgtgtgtgtgtgtgtgtgtgtgtgtgtgtgtgtgtgtttggctgtgggttagttgtgccgttctgctggaacaccgtgggaaggcagtagacgcgggcagtcagctagcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctcta

SEQ ID NO: 111182 - DNA, 783 bp, Homo sapiens; identical to SEQ ID NO: 111073
  Payload ID: 1783
  Gene Symbol: BAG6
  Gene Name: BCL2-associated athanogene 6
  ENST ID: ENST00000441793
  CDS Start-End: 1-680

SEQ ID NO: 111183 - DNA, 1051 bp, Homo sapiens; identical to SEQ ID NO: 111091
  Payload ID: 1783
  Gene Symbol: BAG6
  Gene Name: BCL2-associated athanogene 6
  ENST ID: ENST00000412992
  CDS Start-End: 266-1051

SEQ ID NO: 111184 - DNA, 554 bp, Homo sapiens; identical to SEQ ID NO: 111054
  Payload ID: 1783
  Gene Symbol: BAG6
  Gene Name: BCL2-associated athanogene 6
  ENST ID: ENST00000431516
  CDS Start-End: 1-554

SEQ ID NO: 111185 - DNA, 680 bp, Homo sapiens; identical to SEQ ID NO: 111056
  Payload ID: 1783
  Gene Symbol: BAG6
  Gene Name: BCL2-associated athanogene 6
  ENST ID: ENST00000457802
  CDS Start-End: 1-680

SEQ ID NO: 111186 - DNA, 3630 bp, Homo sapiens
  Payload ID: 1783
  Gene Symbol: BAG6
  Gene Name: BCL2-associated athanogene 6
  Uniprot ID: P46379
  ENST ID: ENST00000552605
  CDS Start-End: 291-3524
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggtctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctct

SEQ ID NO: 111187 - DNA, 3630 bp, Homo sapiens; identical to SEQ ID NO: 111186
  Payload ID: 1783
  Gene Symbol: BAG6
  Gene Name: BCL2-associated athanogene 6
  Uniprot ID: P46379
  ENST ID: ENST00000551350
  CDS Start-End: 291-3524

SEQ ID NO: 111188 - DNA, 3630 bp, Homo sapiens; identical to SEQ ID NO: 111186
  Payload ID: 1783
  Gene Symbol: BAG6
  Gene Name: BCL2-associated athanogene 6
  Uniprot ID: P46379
  ENST ID: ENST00000552116
  CDS Start-End: 291-3524

SEQ ID NO: 111189 - DNA, 3626 bp, Homo sapiens
  Payload ID: 1783
  Gene Symbol: BAG6
  Gene Name: BCL2-associated athanogene 6
  ENST ID: ENST00000546462
  CDS Start-End: 291-3524
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctct

SEQ ID NO: 111190 - DNA, 3626 bp, Homo sapiens; identical to SEQ ID NO: 111189
  Payload ID: 1783
  Gene Symbol: BAG6
  Gene Name: BCL2-associated athanogene 6
  ENST ID: ENST00000552467
  CDS Start-End: 291-3524

SEQ ID NO: 111191 - DNA, 3626 bp, Homo sapiens; identical to SEQ ID NO: 111189
  Payload ID: 1783
  Gene Symbol: BAG6
  Gene Name: BCL2-associated athanogene 6
  ENST ID: ENST00000550393
  CDS Start-End: 291-3524

SEQ ID NO: 111192 - DNA, 3104 bp, Homo sapiens; identical to SEQ ID NO: 111107
  Payload ID: 1783
  Gene Symbol: BAG6
  Gene Name: BCL2-associated athanogene 6
  Uniprot ID: P46379
  ENST ID: ENST00000621056
  CDS Start-End: 291-3002

SEQ ID NO: 111193 - DNA, 3104 bp, Homo sapiens; identical to SEQ ID NO: 111107
  Payload ID: 1783
  Gene Symbol: BAG6
  Gene Name: BCL2-associated athanogene 6
  Uniprot ID: P46379
  ENST ID: ENST00000615224
  CDS Start-End: 291-3002

SEQ ID NO: 111194 - DNA, 3104 bp, Homo sapiens; identical to SEQ ID NO: 111107
  Payload ID: 1783
  Gene Symbol: BAG6
  Gene Name: BCL2-associated athanogene 6
  Uniprot ID: P46379
  ENST ID: ENST00000613474
  CDS Start-End: 291-3002

SEQ ID NO: 111195 - DNA, 3108 bp, Homo sapiens
  Payload ID: 1783
  Gene Symbol: BAG6
  Gene Name: BCL2-associated athanogene 6
  Uniprot ID: P46379
  ENST ID: ENST00000615725
  CDS Start-End: 291-3002
tggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcagagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgggcgccggtctgggtaccaatgcctcgttggcccagatggtgagcggccttgtggggcagcttcttatgcagccagtccttgtggctcaggggaccccagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcaggaatgggtccctattatccagcaggacattcagagccagcggaaggtgaaaccgcagccccctctgagtgatgcctacctcagtggtatgcctgccaagagacgcaagctccggtctgatatacaaaaacgactgcaggaagaccccaactacagtccccagcgcttccccaatgcccagcgggcctttgctgatgatccttagctctttctttgctctatggcccttcctcatcaggggaccgtttcccccctcttccttcacagtatttaagaaataaaagtcggatttttctggctgctttctctct

SEQ ID NO: 111196 - DNA, 3108 bp, Homo sapiens; identical to SEQ ID NO: 111195
  Payload ID: 1783
  Gene Symbol: BAG6
  Gene Name: BCL2-associated athanogene 6
  Uniprot ID: P46379
  ENST ID: ENST00000615143
  CDS Start-End: 291-3002

SEQ ID NO: 111197 - DNA, 3108 bp, Homo sapiens; identical to SEQ ID NO: 111195
  Payload ID: 1783
  Gene Symbol: BAG6
  Gene Name: BCL2-associated athanogene 6
  Uniprot ID: P46379
  ENST ID: ENST00000617635
  CDS Start-End: 291-3002

SEQ ID NO: 111198 - DNA, 7110 bp, Homo sapiens
  Payload ID: 1784
  Gene Symbol: BCLAF1
  Gene Name: BCL2-associated transcription factor 1
  Uniprot ID: Q9NYF8
  ENST ID: ENST00000353331
  CDS Start-End: 254-2863
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctc

SEQ ID NO: 111199 - DNA, 2610 bp, Homo sapiens
  Payload ID: 1784
  Gene Symbol: BCLAF1
  Gene Name: BCL2-associated transcription factor 1
  Uniprot ID: Q9NYF8
  ENST ID: ENST00000392348
  CDS Start-End: 1-2610
atgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataa

SEQ ID NO: 111200 - DNA, 2423 bp, Homo sapiens
  Payload ID: 1784
  Gene Symbol: BCLAF1
  Gene Name: BCL2-associated transcription factor 1
  ENST ID: ENST00000529826
  CDS Start-End: 247-2423
atcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactcc

SEQ ID NO: 111201 - DNA, 3237 bp, Homo sapiens
  Payload ID: 1784
  Gene Symbol: BCLAF1
  Gene Name: BCL2-associated transcription factor 1
  ENST ID: ENST00000532384
  CDS Start-End: 244-2502
ggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtacc

SEQ ID NO: 111202 - DNA, 4239 bp, Homo sapiens
  Payload ID: 1784
  Gene Symbol: BCLAF1
  Gene Name: BCL2-associated transcription factor 1
  ENST ID: ENST00000534269
  CDS Start-End: 198-1601
ttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaaggtcctggaatatgttttgaaatggcaaaatccatgtttcaaagtaaaatagctgttgaaagatacaggcaaagttgaatcttctgtcttcctggcaaaaatggcataaaaactgagttgctagctcaaattcctgggtttcatggaattatgattgaggcactacccttgtagtggccgtttcaagttttaatgattggttatgagacatgtgctggatattgggcgagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcag

SEQ ID NO: 111203 - DNA, 4373 bp, Homo sapiens
  Payload ID: 1784
  Gene Symbol: BCLAF1
  Gene Name: BCL2-associated transcription factor 1
  Uniprot ID: Q9NYF8
  ENST ID: ENST00000527759
  CDS Start-End: 198-2954
ttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgt

SEQ ID NO: 111204 - DNA, 7263 bp, Homo sapiens
  Payload ID: 1784
  Gene Symbol: BCLAF1
  Gene Name: BCL2-associated transcription factor 1
  Uniprot ID: Q9NYF8
  ENST ID: ENST00000531224
  CDS Start-End: 254-3016
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataactgctgttgtttgtttacctgtgtctatttcacacatcttatttctgtggcctattttagaatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactcctattgttttagaaacatgcagtaatgattaacttgtgtcaatgatggtaatgagaccaaacttgtacatttaattaagggtaccagttctttttatgttactagactataccttggcctttaaaaatgaatctcactgattaaagagaacaggcattattaggatagcattccaccacaactagaaacattcaaataatgtgtcttaattgtaatctgtatataggaaaatttttcctatggatatttttggtgttttaccacagtgaactgatttgtagcacttatgaagtgcagaaggtaatattcttgaaaatagaaaaaggttgggtgagcaggctttaatgcctttcccccaagaatatacatcgaatttttcttaatcttttggggttggccagcttccagatttcattaataatgagctctgcctttaataaaagtacatgatcatagctacactgtatgtttaggtggtgtgaaatgatttataatcacagcttgaactgtgtttgcttggtactgtcatagtgattacaaatttcatggaatgcgaagagcaacaataaataaaaaataccactcaccctc

SEQ ID NO: 111205 - DNA, 5371 bp, Homo sapiens
  Payload ID: 1784
  Gene Symbol: BCLAF1
  Gene Name: BCL2-associated transcription factor 1
  ENST ID: ENST00000527536
  CDS Start-End: 232-2847
gacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaagtaataa

SEQ ID NO: 111206 - DNA, 3167 bp, Homo sapiens
  Payload ID: 1784
  Gene Symbol: BCLAF1
  Gene Name: BCL2-associated transcription factor 1
  ENST ID: ENST00000530429
  CDS Start-End: 187-2439
cttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgtt

SEQ ID NO: 111207 - DNA, 5640 bp, Homo sapiens
  Payload ID: 1784
  Gene Symbol: BCLAF1
  Gene Name: BCL2-associated transcription factor 1
  ENST ID: ENST00000527613
  CDS Start-End: 198-2456
ttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatgaggacaaaaactttggaatagcaagctaacactgaaaaaaaaaatgacaaattaatgtgtcctattatccaggctacatcaggaggttggacttcaatgcagtgcatttctagaaacagtttgttaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggacccttgtaaattgtcatacgccaataaaatgtcacaa

SEQ ID NO: 111208 - DNA, 4186 bp, Homo sapiens
  Payload ID: 1784
  Gene Symbol: BCLAF1
  Gene Name: BCL2-associated transcription factor 1
  Uniprot ID: Q9NYF8
  ENST ID: ENST00000530767
  CDS Start-End: 184-2427
gagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagtaaacataaaagagagcaagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaattgtactgaaataaagtagaaaattgttacgtaccatatttgtaactatcaacttttaaaacttttaacgtttttgttacatgcattgtaattctgctttgtctataagatatggtcaagtacagctctgtgaaagttctgattctcttccttccctgtttgtcaatgttttattctgaagtaaacgttagctctacatataaatcctggaacagaaattgtttatagagactacactaattattttaactgtatacatctgtttaatttgaacacactacatcgtagggtgactgatttttgaagtataccacagacaaaaagttgttactatggtaaactaagctagtttaacacttgagcaaatgcttaagaaggaattaaaaaaaaaaagctttgccaatagctaaaaagtacaagctattaaaaatcagattgaaaagttttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaa

SEQ ID NO: 111209 - DNA, 574 bp, Homo sapiens
  Payload ID: 1784
  Gene Symbol: BCLAF1
  Gene Name: BCL2-associated transcription factor 1
  ENST ID: ENST00000533621
  CDS Start-End: 1-357
cagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgatagggtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgt

SEQ ID NO: 111210 - DNA, 744 bp, Homo sapiens
  Payload ID: 1784
  Gene Symbol: BCLAF1
  Gene Name: BCL2-associated transcription factor 1
  ENST ID: ENST00000534762
  CDS Start-End: 1-562
gggctccagggaatccagtggatcaagaaagcaggaaaaaactccaaaagattacaaggaatacaaatcttacaaagatgacagttctcgagaagaaaaggagagtaagaaggaaagagaagaagaatttaaaactcaccatgaaatgaaagaatactcaggctttgcaggagttagccgaccacgaggaaccttttttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttgcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaatgtaagcattttacttaaattttactgtttgcaagtagtctatagaaattttgttttaagtcttcaaatatcttgagaaatagtagactgtatgttgaaaatt

SEQ ID NO: 111211 - DNA, 692 bp, Homo sapiens
  Payload ID: 1784
  Gene Symbol: BCLAF1
  Gene Name: BCL2-associated transcription factor 1
  ENST ID: ENST00000533422
  CDS Start-End: 1-380
aagatcattctcgatcttcatcctcttcagcatcaccttcttctcccagttctcgagaagaaaaggagagtaagaaggaaagagaagaagaatttaaaactcaccatgaaatgaaagaatactcaggctttgcaggagttagccgaccacgaggaacctttcatgacgacagagatgatggtgtggattattgggccaaaagaggaagaggtcgtggtacttttcaacgtggcagagggcgctttaacttcaaaaaatcaggtagcagtcctaaatggactcatgacaaataccaaggggatgggattgttgaagatgaagaagagaccatggaaaataatgaagaaaagaaggacagacgcaaggaagaaaaggaataataaatatgaagtaagattacaacagagcagaacttgcacccaccattttttttacctgatttttgttttcaaataagaataatatcagcgcatctgttaggaagattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtcca

SEQ ID NO: 111212 - DNA, 2512 bp, Homo sapiens
  Payload ID: 1784
  Gene Symbol: BCLAF1
  Gene Name: BCL2-associated transcription factor 1
  ENST ID: ENST00000628517
  CDS Start-End: 254-2512
gccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggaattcgaatttagagtttaatttctcagagcattctctccaggaagaatttttacagtatctcaaagacttcacttgacttcttgatcctgcataaaaccaaggagaaaagaaatgggtcgctccaattctagatcacattcttcaaggtcaaagtctagatcacagtctagttctcgatcaagatcaagatctcattctagaaagaagcgatacagttctaggtctcgttccagaacatattcaaggtctcgtagtagagatcgtatgtattctagagattatcgtcgcgattacagaaataatagaggaatgagacgaccttatgggtacagaggaaggggtagagggtattatcaaggaggaggaggtagatatcatcgaggtggttatagacctgtctggaatagaaggcactctaggagtcctagacgaggtcgttcacgttccaggagtccaaaaagaagatccgtttcttctcaaagatccagaagcagatctcgccggtcatatagatcttctaggtctccaagatcatcctcttctcgttcttcatccccatatagcaaatctcctgtttctaaaagacgagggtctcaggaaaaacaaaccaaaaaagctgaaggggaaccccaagaagagagtccgttgaaaagtaaatcacaggaggaaccgaaagatacatttgaacatgacccatctgagtctatcgatgaatttaataagtcatcagccacatccggtgatatttggcctggcctttcagcttatgataatagtcctagatcaccccatagtccttcacctattgctacaccacctagtcagagttcatcttgctctgatgctcccatgctcagtacagttcactctgcaaaaaatactccttctcagcattcacattccattcagcatagtcctgaaaggtctgggtctggttctgttggaaatggatctagtcgatacagtccttctcagaatagtccaattcatcacatcccttcacgaagaagtcctgcaaagacaatcgcaccacagaatgctccaagagatgagtctaggggccgttcctcgttttatcctgatggtggagatcaggaaactgcaaagactgggaagttcttaaaaaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatgttaaagagcaatacttcaagtcagctgcaatgaccctaaacgagcggttcacttcgtatcagaaagccactgaagaacatagtactcggcaaaagagccctgaaatacacaggagaattgacatctcaccaagtaccctgaggaagcatacccgtttagcaggggaagagagagtttttaaagaagaaaatcaaaagggagataaaaaattaaggtgtgactctgctgaccttcggcatgacattgatcgccgtagaaaagaaagaagtaaagaacggggagattccaagggctccagggaatccagtggatcaagaaagcaggaaaaaactccaaaagattacaaggaatacaaatcttacaaagatgacagcaaaaatgtatttgtcttttacacggcttatggtggatga

SEQ ID NO: 111213 - DNA, 793 bp, Homo sapiens
  Payload ID: 1785
  Gene Symbol: BAX
  Gene Name: BCL2-associated X protein
  Uniprot ID: Q07812
  ENST ID: ENST00000345358
  CDS Start-End: 53-631
gctgcggccgcccgcgcggacccggcgagaggcggcggcgggagcggcggtgatggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 111214 - DNA, 1358 bp, Homo sapiens
  Payload ID: 1785
  Gene Symbol: BAX
  Gene Name: BCL2-associated X protein
  Uniprot ID: Q07812
  ENST ID: ENST00000293288
  CDS Start-End: 1-657
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggacaca

SEQ ID NO: 111215 - DNA, 433 bp, Homo sapiens
  Payload ID: 1785
  Gene Symbol: BAX
  Gene Name: BCL2-associated X protein
  Uniprot ID: Q07812
  ENST ID: ENST00000354470
  CDS Start-End: 1-432
atggacgggtccggggagcagcccagaggcggggggcccaccagctctgagcagatcatgaagacaggggcccttttgcttcaggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgag

SEQ ID NO: 111216 - DNA, 677 bp, Homo sapiens
  Payload ID: 1785
  Gene Symbol: BAX
  Gene Name: BCL2-associated X protein
  Uniprot ID: Q07812
  ENST ID: ENST00000356483
  CDS Start-End: 1-495
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggctggcgtgaaatggcgtgatctgggctcactgcaacctctgcctcctgggttcaagcgattcacctgcctcagcatcccaaggagctgggattacaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctga

SEQ ID NO: 111217 - DNA, 687 bp, Homo sapiens
  Payload ID: 1785
  Gene Symbol: BAX
  Gene Name: BCL2-associated X protein
  ENST ID: ENST00000391871
  CDS Start-End: 1-528
atggacgggtccggggagcagcccagaggcgggggttttcatccaggatcgagcagggcgaatgggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacgtgggcatttttcttacttttgtaattattggggggtgtggggaagagtggtcttgagggggtaataaacctccttcgggac

SEQ ID NO: 111218 - DNA, 540 bp, Homo sapiens
  Payload ID: 1785
  Gene Symbol: BAX
  Gene Name: BCL2-associated X protein
  Uniprot ID: Q07812
  ENST ID: ENST00000415969
  CDS Start-End: 1-540
atggacgggtccggggagcagcccagaggcggggggcccaccagctctgagcagatcatgaagacaggggcccttttgcttcagggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttggaccgtgaccatctttgtggcgggagtgctcaccgcctcactcaccatctggaagaagatgggctga

SEQ ID NO: 111219 - DNA, 383 bp, Homo sapiens
  Payload ID: 1785
  Gene Symbol: BAX
  Gene Name: BCL2-associated X protein
  ENST ID: ENST00000506183
  CDS Start-End: 1-380
atggacgggtccggggagcagcccagaggcgggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggacggcctcctctcctactttgggacgcccacgtggcagaccgtgaccatctttgtggcgggagtgctcaccgcctcactcaccatctggaagaagatgggctgaggc

SEQ ID NO: 111220 - DNA, 300 bp, Homo sapiens
  Payload ID: 1785
  Gene Symbol: BAX
  Gene Name: BCL2-associated X protein
  Uniprot ID: Q07812
  ENST ID: ENST00000515540
  CDS Start-End: 1-126
atggacgggtccggggagcagcccagaggcggggtttcatccaggatcgagcagggcgaatggggggggaggcacccgagctggccctggacccggtgcctcaggatgcgtccaccaagaagctgagcgagtgtctcaagcgcatcggggacgaactggacagtaacatggagctgcagaggatgattgccgccgtggacacagactccccccgagaggtctttttccgagtggcagctgacatgttttctgacggcaacttcaactggggccgggttgtcgcccttttctactttgcca

SEQ ID NO: 111221 - DNA, 458 bp, Homo sapiens
  Payload ID: 1785
  Gene Symbol: BAX
  Gene Name: BCL2-associated X protein
  ENST ID: ENST00000539787
  CDS Start-End: 36-458
atggacgggtccggggagcagcccagaggcgggggatgattgccgccgtggacacagactccccccgagaggtctttttccgagtggcagctgacatgttttctgacggcaacttcaactggggccgggttgtcgcccttttctactttgccagcaaactggtgctcaaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctga

SEQ ID NO: 111222 - DNA, 953 bp, Homo sapiens
  Payload ID: 1786
  Gene Symbol: BIK
  Gene Name: BCL2-interacting killer (apoptosis-inducing)
  Uniprot ID: Q13323
  ENST ID: ENST00000216115
  CDS Start-End: 64-546
gcagacacgaagcctcccgggtggcttacagacgctgccagcatcgccgccgccagaggagaaatgtctgaagtaagacccctctccagagacatcttgatggagaccctcctgtatgagcagctcctggaacccccgaccatggaggttcttggcatgactgactctgaagaggacctggaccctatggaggacttcgattctttggaatgcatggagggcagtgacgcattggccctgcggctggcctgcatcggggacgagatggacgtgagcctcagggccccgcgcctggcccagctctccgaggtggccatgcacagcctgggtctggctttcatctacgaccagactgaggacatcagggatgttcttagaagtttcatggacggtttcaccacacttaaggagaacataatgaggttctggagatccccgaaccccgggtcctgggtgtcctgcgaacaggtgctgctggcgctgctgctgctgctggcgctgctgctgccgctgctcagcgggggcctgcacctgctgctcaagtgaggccccggcggctcagggcggggctggccccacccccatgaccactgccctggaggtggcggcctgctgctgttatctttttaactgttttctcatgatgcctttttatatttaaaccccgagatagtgctggaacactgctgaggttttatactcaggttttttgttttttttttattccagttttcgttttttctaaaagatgaattcctatggctctgcaattgtcaccggttaactgtggcctgtgcccaggaagagccattcactcctgcccctgcccacacggcaggtagcagggggagtgctggtcacacccctgtgtgatatgtgatgccctcggcaaagaatctactggaatagattccgaggagcaggagtgctcaataaaatgttggtttccagca

SEQ ID NO: 111223 - DNA, 1241 bp, Homo sapiens
  Payload ID: 1787
  Gene Symbol: BCL2L2-PABPN1
  Gene Name: BCL2L2-PABPN1 readthrough
  Uniprot ID: Q92843
  ENST ID: ENST00000553781
  CDS Start-End: 157-1158
ctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaagaattaaaaaaaaaaaaaagaaaaa

SEQ ID NO: 111224 - DNA, 1366 bp, Homo sapiens
  Payload ID: 1787
  Gene Symbol: BCL2L2-PABPN1
  Gene Name: BCL2L2-PABPN1 readthrough
  Uniprot ID: Q92843
  ENST ID: ENST00000557008
  CDS Start-End: 322-1323
tttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaa

SEQ ID NO: 111225 - DNA, 2610 bp, Homo sapiens
  Payload ID: 1788
  Gene Symbol: BCL2L1
  Gene Name: BCL2-like 1
  Uniprot ID: Q07817
  ENST ID: ENST00000307677
  CDS Start-End: 412-1113
gcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 111226 - DNA, 2383 bp, Homo sapiens
  Payload ID: 1788
  Gene Symbol: BCL2L1
  Gene Name: BCL2-like 1
  Uniprot ID: Q07817
  ENST ID: ENST00000376055
  CDS Start-End: 374-886
gggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 111227 - DNA, 2578 bp, Homo sapiens
  Payload ID: 1788
  Gene Symbol: BCL2L1
  Gene Name: BCL2-like 1
  Uniprot ID: Q07817
  ENST ID: ENST00000376062
  CDS Start-End: 380-1081
ggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtgaacaaaga

SEQ ID NO: 111228 - DNA, 781 bp, Homo sapiens
  Payload ID: 1788
  Gene Symbol: BCL2L1
  Gene Name: BCL2-like 1
  ENST ID: ENST00000439267
  CDS Start-End: 239-781
ctttgcgtctcgggctcgcgcgcgttgccgcggcaccggaagtgactgagcttgcaagttcccctgtctcttcaggggaaactgaggccggcttgttcgggagagacggcgcgagcagtcagccagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttgg

SEQ ID NO: 111229 - DNA, 820 bp, Homo sapiens
  Payload ID: 1788
  Gene Symbol: BCL2L1
  Gene Name: BCL2-like 1
  ENST ID: ENST00000420488
  CDS Start-End: 257-820
ctttgcgtctcgggctcgcgcgcgttgccgcggcaccggaagtgactgagcttgcaagttcccctgtctcttcaggggaaactgaggccggcttgttcgggagagacggcgcgagcagtcagccagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 111230 - DNA, 914 bp, Homo sapiens
  Payload ID: 1788
  Gene Symbol: BCL2L1
  Gene Name: BCL2-like 1
  ENST ID: ENST00000456404
  CDS Start-End: 351-914
ccggaagtgactgagcttgcaagttcccctgtctcttcaggggaaactgaggccggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 111231 - DNA, 381 bp, Homo sapiens
  Payload ID: 1788
  Gene Symbol: BCL2L1
  Gene Name: BCL2-like 1
  ENST ID: ENST00000434194
  CDS Start-End: 236-381
tttcggagaagacgggggtagaaaaggctggtgggagattcagagtccactggtgctttcgatttgacttaagtgaagtatcttggaacctagacccagaccttcctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccag

SEQ ID NO: 111232 - DNA, 894 bp, Homo sapiens
  Payload ID: 1788
  Gene Symbol: BCL2L1
  Gene Name: BCL2-like 1
  ENST ID: ENST00000450273
  CDS Start-End: 279-894
ggcttgttcgggagagacggcgcgagcagtcagccaggtaggccggcagccaggtaggccggcccgggtccgcggcgcggaactcggccgcgaagagctcttgcgtctggaagctaccgggccgatgaagggggatgtggccccccacggctcgcggggctcgcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggatacttttgtggaactctatgggaacaatgcagcagccgagagccgaaagg

SEQ ID NO: 111233 - DNA, 1157 bp, Homo sapiens
  Payload ID: 1788
  Gene Symbol: BCL2L1
  Gene Name: BCL2-like 1
  ENST ID: ENST00000422920
  CDS Start-End: 594-1157
gaaaccttgaaccccattgagaagtccctttagggtttcggacgcctccacctcaccctgggctggtgcttaaatagaaaaaagaaaaacaaaaaccaactaaatccataccagccacctccgggagagtactcctggctcccagtaggaggcggagagccaaggggcgtgcaagagagagggggctgggctcccgggtggcaggaggccgcggctgcggagcggccgccctcgatccgggcgatggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaataatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgg

SEQ ID NO: 111234 - DNA, 1249 bp, Homo sapiens
  Payload ID: 1789
  Gene Symbol: BCL2L10
  Gene Name: BCL2-like 10 (apoptosis facilitator)
  Uniprot ID: Q9HD36
  ENST ID: ENST00000260442
  CDS Start-End: 50-664
cgggccaagaaaaccagcgaaggcccggccccccagcagaggccggaccatggttgaccagttgcgggagcgcaccaccatggccgacccgctgcgggagcgcaccgagctgttgctggccgactacctggggtactgcgcccgggaacccggcacccccgagccggcgccatccacgcccgaggccgccgtgctgcgctccgcggccgccaggttacggcagattcaccggtcctttttctccgcctacctcggctaccccgggaaccgcttcgagctggtggcgctgatggcggattccgtgctctccgacagccccggccccacctggggcagagtggtgacgctcgtgaccttcgcagggacgctgctggagagagggccgctggtgaccgcccggtggaagaagtggggcttccagccgcggctaaaggagcaggagggcgacgtcgcccgggactgccagcgcctggtggccttgctgagctcgcggctcatggggcagcaccgcgcctggctgcaggctcagggcggctgggatggcttttgtcacttcttcaggaccccctttccactggctttttggagaaaacagctggtccaggcttttctgtcatgcttgttaacaacagccttcatttatctctggacacgattattatgagttttaaaacttttaacccgcttctacctgcccaactgtgaccaactaaatgacagatgtgtgagaacaagaactgagggaaagcaccttcccccaccccagacgtttttatctgaatgcatacaaggagtcctgaggtggtgatttggccagtgttttaacttgtgacaagtactcaggtgtgaggacaagaatgcaaatggctcttccttgagtgaaagaaatggggagtctagagcctctttatgccaaagaaccgcagaagaaactgcattccattaaatgggaaatacagtgctatttgctaaaacttggataagagtgcgaacctctcatctctccacaacttcatgtgctgctgactaattttaaacatggccacagctggggcaaaataatccccaaagtagaaaaagtcccagtttaacaaagaatgtaatgttaaaatcacttataaggaattctttgaaaccaaatcctttgaaatctaattcctgggacttctaggtttttatagttaacatactaatttcttcaataattgttaactgcaaagttttaataaatttgtacctttaaaaaaaa

SEQ ID NO: 111235 - DNA, 825 bp, Homo sapiens
  Payload ID: 1789
  Gene Symbol: BCL2L10
  Gene Name: BCL2-like 10 (apoptosis facilitator)
  ENST ID: ENST00000561198
  CDS Start-End: 43-768
agaaaaccagcgaaggcccggccccccagcagaggccggaccatggttgaccagttgcgggagcgcaccaccatggccgacccgctgcgggagcgcaccgagctgttgctggccgactacctggggtactgcgcccgggaacccggcacccccgagccggcgccatccacgcccgaggccgccgtgctgcgctccgcggccgccaggttacggcagattcaccggtcctttttctccgcctacctcggctaccccgggaaccgcttcgagctggtggcgctgatggcggattccgtgctctccgacagccccggccccacctggggcagagtggtgacgctcgtgaccttcgcagggacgctgctggagagagggccgctggtgaccgcccggtggaagaagtggggcttccagccgcggctaaaggagcaggagggcgacgtcgcccgggactgccagcgcctggtggccttgctgagctcgcggctcatggggcagcaccgcgcctggctgcaggctcagggcggctgggtgagcacgcggcggacaccgggacacggggcgggacgggcagccgggaagcgcccacgaggctggcacggatggcttttgtcacttcttcaggaccccctttccactggctttttggagaaaacagctggtccaggcttttctgtcatgcttgttaacaacagccttcatttatctctggacacgattattatgagttttaaaacttttaacccgcttctacctgcccaactgtgaccaactaaatgacagatgtgtgagaacaagaactgagggaaagcaccttcccccacc

SEQ ID NO: 111236 - DNA, 1522 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000308659
  CDS Start-End: 289-705
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcag

SEQ ID NO: 111237 - DNA, 720 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000337565
  CDS Start-End: 289-627
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtattttaatattg

SEQ ID NO: 111238 - DNA, 947 bp, Homo sapiens
  Payload ID: 1790
  Gene Symbol: BCL2L11
  Gene Name: BCL2-like 11 (apoptosis facilitator)
  ENST ID: ENST00000357757
  CDS Start-End: 289-585
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggatgactccgctggatcctccctcagaattgcccttcatagggaagttcagtggccactcaagtggttagcaaaatcaagctaactgggactagaaacagctccatcacccagtaaagagaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagctttcatttcaaataaaaccattttat

SEQ ID NO: 111239 - DNA, 443 bp, Homo sapiens
  Payload ID: 1790
  Gene Symbol: BCL2L11
  Gene Name: BCL2-like 11 (apoptosis facilitator)
  ENST ID: ENST00000361493
  CDS Start-End: 1-228
atggcaaagcaaccttctgatgtaagttctgagtgtgaccgagaaggtagacaattgcagcctgcggagaggcctccccagctcagacctggggcccctacctccctacagacagagccacaagtctcactctgtcacccaggctggagtgcactggtgcgatcttggctcactgcaacctccaactcccaagttcaagcggttctcctgcctcagcctcccaagtagctgggattacagcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattga

SEQ ID NO: 111240 - DNA, 482 bp, Homo sapiens
  Payload ID: 1790
  Gene Symbol: BCL2L11
  Gene Name: BCL2-like 11 (apoptosis facilitator)
  ENST ID: ENST00000393252
  CDS Start-End: 268-482
gcggccggggcagcgcgggccagaggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggccc

SEQ ID NO: 111241 - DNA, 5086 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000393256
  CDS Start-End: 274-870
gccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtttt

SEQ ID NO: 111242 - DNA, 425 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000405953
  CDS Start-End: 1-339
atggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggtagtcatcctagaggatataggtgatctttcactgtgctttggatttatatttactggcttagatttgtatggccaccaccatagtcaagatacagaacaactcaaccacaaggatttctcatgatacctttttatagccacagccacctctctccctcttccttgagcattttgtcatatggtcattggtgattaaataaaatgtatttt

SEQ ID NO: 111243 - DNA, 656 bp, Homo sapiens
  Payload ID: 1790
  Gene Symbol: BCL2L11
  Gene Name: BCL2-like 11 (apoptosis facilitator)
  ENST ID: ENST00000438054
  CDS Start-End: 1-291
aagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggatgactccgctggatcctccctcagaattgcccttcatagggaagttcagtggccactcaagtggttagcaaaatcaagctaactgggactagaaacagctccatcacccagtaaagagaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagctttcatttcaaataaaaccattttataga

SEQ ID NO: 111244 - DNA, 459 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000452231
  CDS Start-End: 1-249
atggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattga

SEQ ID NO: 111245 - DNA, 438 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000415458
  CDS Start-End: 1-243
atggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattga

SEQ ID NO: 111246 - DNA, 883 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000431217
  CDS Start-End: 1-408
atggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggctaactgggactagaaacagctccatcacccagcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggc

SEQ ID NO: 111247 - DNA, 1197 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000433098
  CDS Start-End: 244-573
ggcgcggcgtgcggagccctcggctgcccggcggagcgcggcggcgggctggcgggaaggcgcgggctttgcgctgcgccggggactctgaacccgagtcccgggctttgtctcctgcgctgctttcgtggtgacggtcagggggcgcccggtcggcgaagggcgcgggccggacgccgcggggcttggtccctggcccggacgctgcgctctgaagggaaggcgcggacaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctc

SEQ ID NO: 111248 - DNA, 618 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000436733
  CDS Start-End: 1-423
atggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattga

SEQ ID NO: 111249 - DNA, 936 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000439718
  CDS Start-End: 1-258
atggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggctggcaaaactcctggcatcctccacctgacataaaccagttcacagaacattccagcctagatctgaaatgttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctc

SEQ ID NO: 111250 - DNA, 572 bp, Homo sapiens
  Payload ID: 1790
  Gene Symbol: BCL2L11
  Gene Name: BCL2-like 11 (apoptosis facilitator)
  ENST ID: ENST00000432179
  CDS Start-End: 206-572
gacgcgcgtcctccagcgactccgggaacccaaggcctccttcacctcgctcaaaattcacccgaaaatgcgctgagactttggcatggggctgcgctgtgtcccactgacgttacagaagcgcttatgaatttaaaaactgctccaggcggccggacggcgggacaacgcctcctcacttgctcctctacgaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccagg

SEQ ID NO: 111251 - DNA, 729 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000437029
  CDS Start-End: 1-519
atggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattga

SEQ ID NO: 111252 - DNA, 5044 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000620862
  CDS Start-End: 289-618
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111253 - DNA, 5132 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000619294
  CDS Start-End: 289-696
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggctaactgggactagaaacagctccatcacccagcttccatgaggcaggctgaacctgcagatatgcgcccagagatatggatcgcccaagagttgcggcgtattggagacgagtttaacgcttactatgcaaggagggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111254 - DNA, 5120 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000610735
  CDS Start-End: 289-711
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111255 - DNA, 5026 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000615946
  CDS Start-End: 289-546
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaagcttccatgaggcaggctgaacctgcagatatgcgcccagagatatggatcgcccaagagttgcggcgtattggagacgagtttaacgcttactatgcaaggaggctggcaaaactcctggcatcctccacctgacataaaccagttcacagaacattccagcctagatctgaaatgttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111256 - DNA, 5224 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000621302
  CDS Start-End: 289-798
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggttagagaaatagaggaagttgtcgtgtagttgtcatgtattcagtccacttaagggcagtggggaagcgtttgagacggagctgtggaggctgaatccttgaaggaggaggtgagagaggcacaggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111257 - DNA, 5231 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000622509
  CDS Start-End: 289-807
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatggcttccatgaggcaggctgaacctgcagatatgcgcccagagatatggatcgcccaagagttgcggcgtattggagacgagtttaacgcttactatgcaaggaggatgcctcttccacctgattaagaaccactgtagcagacgcagacttattggacactaggcgggaggccagctctgcagacagcaggtctcaggaagacggtcaaggcatggctgctgatgatccgcttatgggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111258 - DNA, 4995 bp, Homo sapiens
  Payload ID: 1790
  Gene Symbol: BCL2L11
  Gene Name: BCL2-like 11 (apoptosis facilitator)
  Uniprot ID: O43521
  ENST ID: ENST00000622612
  CDS Start-End: 289-696
acttcgctccgcgcagccgcctggtctgcagtttgttggagctctgcgtccagcgccgctgccgctgccgccgccgccgccgccgccgccgccgccgccgccgccgccactaccaccacttgattcttgcagccaccctgcgaaccctgccacactgcgatcgcatcatcgcggtattcggttcgctgcgttcccgccgccaccgcctcggcgccctttcttggcccttgttcccccaaatgtctgactctgactctcggactgagaaacgcaagaaaaaaagaccaaatggcaaagcaaccttctgatgtaagttctgagtgtgaccgagaaggtagacaattgcagcctgcggagaggcctccccagctcagacctggggcccctacctccctacagacagagccacaaggtaatcctgaaggcaatcacggaggtgaaggggacagctgcccccacggcagccctcagggcccgctggccccacctgccagccctggcccttttgctaccagatccccgcttttcatctttatgagaagatcctccctgctgtctcgatcctccagtgggtatttctcttttgacacagacaggagcccagcacccatgagttgtgacaaatcaacacaaaccccaagtcctccttgccaggccttcaaccactatctcagtgcaatgggtatttttgaataattaccaagcagccgaagaccacccacgaatggttatcttacgactgttacgttacattgtccgcctggtgtggagaatgcattgacaggttctttgcggagccgagataccatgcagacattttgcttgttcaaaccaacaagacccagcaccgcggtctcctggtgccattattatgcagccagcggttctcttgtggagggggcaggtgacgtttcagaagacaccgagctggatgggactacctttctgttcatcaccacacagcagaatttctaatggaagtttgttgtgaatgtaaaggagggagcattctttgctttttaatatacaaaccatggttttttggagcaggattttgtgtaagaatggtgtttacatgcagtgtgttttccccctcaccttcaataaggtttttcaaaaaggaaatggaaactttttaaccaatttgtgaataacttttgtattaaaattttaagaacctacggcctattctcagaggattatgtaacccctgcagtggaaactgagccagctaacttaaaaagctgccttagtttatttttagagattacagaatttttaaacagggagacgtgtgatatactccctcccttccctactattgcctctctgacctttttaaattatttttaataccaaaagagttcttttgaaatggaactgattaaaagggcagagggtctgttgccagcctgcattgatataccagtcccatttgtaaatatttacgtacctttataaattcagttgcatctgtggcaaaatttcagactatttttgcgtctttcctcatcactttttgtgatgcaactccagtctggactcagatgcatagatttggtccagtgtattttcatgataaagtgaaattgagtcagaacaagagttaatatctgcctgtatcttgcacagttcgagcgatctgttattaactgggaagcatttggtgttggttttcattccatttcgacgagcatgttattgggaagtattctgaagaggcaatagcagtaataacaacagacttaagtgctacgcccctttgtgctgctggcttttctggttgcaggctttcccatggtcacaggatgcactgtcagcatcaggtcccagagggccaccgtgtccattacagcagagtccagctgcagcatccagctcacgccctcatgggaattggcacaggcctggggcagggcttctgatggccatttgcttggcctcctgcattttagtccaactcacagtccactagcttcactcctttaaattcactttgaaacaggcctcatcccacttccaccagcaccatagaagaataattctgggcagaagtctgttttttttcatttttccaggacagttggatattgtcaggccacttgtgaccccagccatgtagtgagggtgctctttctctgtgcctgctccttatgagtgcagtggaaggaagccacacactggtcagtcatttcagaggcagcagatgcccagggagacccaagaaagagtcaggttagggagcagtgaaagtgaggagggaagacaattctgtgaactctgtaactcttaaaatttttgaaaactccatcgttaaacaacttttaaaagaaataactaaattttcaaatgagtaagcagtgccaccaactagtgttttgcccgatagaagagccagcatgttcacgttatttaaattaggtggaaaaatctaaacatttttatcttcataatttaaaaaatatatatgtatatattgcatattcactttttcctttaggtagagatgatttcaatccaaatactcttactttaaaaaatttcctttccccaagaatctccttgggactttgacttatttttaaagctgtgttggagctcatcttgttccctgatgtgtctcgagcccattggtagggtcatacaaagcccacggttacaagcagtggtaggattgcagccgtgggcctgctggacacacacatacaccaaagatgtatttggatctgggcaccccctcccaggatccctgtactcacgtgccagtctcctgactagagcactttactctgtttcctcagccctgcagcccctgggagcacacactgggtgcagccctgggccaggcacgggaggccctgccctgtgctgcccaggggctgtgtgcaccacatgagcacatttccctctggcctggcggcctccaggctggctgtggaaacagttcctgaggaaattagagattctatgaattgtaggagtattaaagaccaggctgttggcaccagaacttaaagcgatgactggatgtctctgtactgtatgtatctggttatcaagatgcctctgtgcagaaagtatgcctcccgtgggtatacgtttttaccttttttaaaaaacatttttgtagaaaaaataattaaatcccctttttggaaacttactgcaggttttgtgccttgacaacctctccctatgtgaggtttgtaaaaagtgtcctgtgacttaacacagaaacgcaataaacacacacaaaatagtttcatgagtgattcttcagatgcccttcccaactggttagttgatcaagaattttgggggtgggggttgcggagaaatcaagtttaaaattccttctgattaaaaaaatatagtggaatacaattgtctgccgtttccccttcttaatgtatatattgtgagtatttattagattcgtaggtcatattacttatcaactgagccaaatgtctgtgtgcaattgtgtttcctttaccttgtaaaattttgtacagcataaataagtaaaaaaatcactgtttttctcaactttttcaaaatcaaggattgtaaatattgtagattctttttctgtgtgatgtgtcctactgtttcataatgctgtaacttgtagaaatattgtatatttattttctgcttatttaatgtcttaatttctgaaaagtattaacatccctgtctcccactcccctgccgtcccatgaagttaactcctgagagttgtcgggggtgactggagagctcattgcagaccacgtggtcctccagggtggctctccaccttcgggtcctggtatttccagtcaagtgggtttcaattcttgggctttgccgcccttatgatgaagtgtgtgtttgatgccagtgagaaactcagtctggcaggctacaaaattctactccaagaaatacccagcaaccttctgtttgttccaaagcaactagcttatcatgcaagcaaattttgctgactccaggctttatctttaggaaaacaaaaaaaccaaagtattatcagcaggtgggaaagatttttctattgaaaatttatccctgacaactcagcgtttagaaaagaaataaaatgtgccacttccagaggtgctgcattgcagttgttcagggctagggccaggcaggacaagtgaatgggtgggacaggtggctcctgcctaaggaccacctcaggccactaaccccttgtggacaactgtgagtagctgggttttcccccacctgctgtgcaacttcctgtgctttgaggttggactaacttgtcttcaggagctaattaactgtacagccctccccacgccccacccatacggtcactgcatttggtcagcctgcttcttcaggtcgatgccctccttctgatactccatctccttcaggggaggttggggccccactggactgggtgtcaagatgtgaaagcttatgggagctttaaggagacttcatggtggttccatgcaggtggttctgccatccctgctgatttagcctggtgcctgtgtgtgtccactcacgtacacgtggggtgggggaaacgtgtctacagatgacgctaaatcagttggggtctactctaaacagcattgtgtgtaagaagcatcctcaagctcccagttaagtaacttgactacttttatttgggaatttcagactatagaagctctcttatgttttatgtccagattctgtgaccactagttactgtatcagaactcatcaggtacccacttataaatagcactgatctggctgtatactgatccatcactaacctgttttctaggacccagcgtatgtagcatttgtattgcagtttccctggcttacttgtgttttgcactgatgaattttgacagggtaattgccactttacttgtgcaatactgctgtaaataactgcagatttttaaacaatcttttatgttaattttataaaaataaaactttcaactagtt

SEQ ID NO: 111259 - DNA, 990 bp, Homo sapiens
  Payload ID: 1791
  Gene Symbol: BCL2L12
  Gene Name: BCL2-like 12 (proline rich)
  ENST ID: ENST00000246784
  CDS Start-End: 70-822
cgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111260 - DNA, 1431 bp, Homo sapiens
  Payload ID: 1791
  Gene Symbol: BCL2L12
  Gene Name: BCL2-like 12 (proline rich)
  Uniprot ID: Q9HB09
  ENST ID: ENST00000246785
  CDS Start-End: 259-1263
ccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111261 - DNA, 1371 bp, Homo sapiens
  Payload ID: 1791
  Gene Symbol: BCL2L12
  Gene Name: BCL2-like 12 (proline rich)
  Uniprot ID: Q9HB09
  ENST ID: ENST00000441864
  CDS Start-End: 259-1260
ccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacc

SEQ ID NO: 111262 - DNA, 620 bp, Homo sapiens
  Payload ID: 1791
  Gene Symbol: BCL2L12
  Gene Name: BCL2-like 12 (proline rich)
  ENST ID: ENST00000594157
  CDS Start-End: 116-394
cggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111263 - DNA, 633 bp, Homo sapiens
  Payload ID: 1791
  Gene Symbol: BCL2L12
  Gene Name: BCL2-like 12 (proline rich)
  ENST ID: ENST00000600947
  CDS Start-End: 78-494
agtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111264 - DNA, 893 bp, Homo sapiens
  Payload ID: 1791
  Gene Symbol: BCL2L12
  Gene Name: BCL2-like 12 (proline rich)
  ENST ID: ENST00000598979
  CDS Start-End: 116-394
cggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111265 - DNA, 510 bp, Homo sapiens
  Payload ID: 1791
  Gene Symbol: BCL2L12
  Gene Name: BCL2-like 12 (proline rich)
  ENST ID: ENST00000598306
  CDS Start-End: 64-342
cagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctgggcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagta

SEQ ID NO: 111266 - DNA, 1259 bp, Homo sapiens
  Payload ID: 1791
  Gene Symbol: BCL2L12
  Gene Name: BCL2-like 12 (proline rich)
  ENST ID: ENST00000611631
  CDS Start-End: 683-1075
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 111267 - DNA, 1402 bp, Homo sapiens
  Payload ID: 1791
  Gene Symbol: BCL2L12
  Gene Name: BCL2-like 12 (proline rich)
  ENST ID: ENST00000614495
  CDS Start-End: 683-1264
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 111268 - DNA, 1854 bp, Homo sapiens
  Payload ID: 1791
  Gene Symbol: BCL2L12
  Gene Name: BCL2-like 12 (proline rich)
  Uniprot ID: Q9HB09
  ENST ID: ENST00000616144
  CDS Start-End: 683-1687
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaagctggcctcggaccccgccctgcgcagcaagctggtccgcctgtcctccgactctttcgcccgcctggtggagctgttctgtagccgggatgacagctctcgcccaagccgagcatgccccgggcccccgcctccttccccggagcccctggcccgcctggccctagccatggagctgagccggcgcgtggccgggctggggggcaccctggccggactcagcgtggagcacgtgcacagcttcacgccctggatccaggcccacgggggctgggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 111269 - DNA, 1630 bp, Homo sapiens
  Payload ID: 1791
  Gene Symbol: BCL2L12
  Gene Name: BCL2-like 12 (proline rich)
  ENST ID: ENST00000619007
  CDS Start-End: 683-1492
aagtaagtatccccactttcagggtagcatcctctttccctagttatttcagtgcagaatcgattcacgtgtaagcctctacctcctgcacttaccccaatgtagacccccttccacagtccccctacagaagatctcccaaaacatttccaacacagaacttccattcaattcccctccgactgcccgcctccctcctccaggacagagcacgccccaggtttcgagactgaactacccccatctacggagtccacccctccctctctagaaccccctcagtgtagacgcctcctcttttcctctttcctccctactttttctagtttttctgcagccgacctccagcgtcggccactgtagctccttccttgctccactttccccagagtacacagcctgcctttccactctccgtgcagacccatcctctttcccgctcctcgctctcggacgccaccaacgctctcccgggctcttccgcgttacctacgatggaaggtcggggcgtgcgggcagctggaacccacccctgtcttggagctccgggtagctctcaaactcgaggctgcgcaccccctttcccgtcagctgagctctagagcgctggggctttctttttgatcgacttcttgaaataaaaccaactttatcattctttgggtaacagacccaaaagccgatgggacggcccgctgggctgttcccgcccctatgcccttttttgggtttccggccagaggcatgctgggagcgtcacatgcaaattgagcgtgcacccagcgttccgccctttctacgctgggccggttatcgacccggcccagtgcgcaggcgcgggaaagttgaactaataaagtttgtacgagttcagtggaggagaccgcaagttgagtggaggaggcggcggtggggccccggaccaggtgcctccatggcaggctctgaagagctggggctccgggaagacacgctgagggtcctagctgccttccttaggcgtggtgaggctgccgggtctcctgttccaactccacctagaagccctgcccaagaagagccaacagacttcctgagccgccttcgaagatgtcttccctgctccctggggcgaggagcagccccctctgagtcccctcggccttgctctctgcccatccgcccctgctatggtttagagcctggcccagctactccagacttctatgctttggtggcccagcggctggaacagctggtccaagagcagctgaaatctccgcccagcccagaattacagggtcccccatcgacagagaaggaagccatactgcggaggctggtggccctgctggaggaggaggcagaagtcattaaccagaaggtgatgggcatctgtcccactccttggcaaggacaggagttgcggaatggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagt

SEQ ID NO: 111270 - DNA, 2992 bp, Homo sapiens
  Payload ID: 1792
  Gene Symbol: BCL2L13
  Gene Name: BCL2-like 13 (apoptosis facilitator)
  Uniprot ID: Q9BXK5
  ENST ID: ENST00000317582
  CDS Start-End: 348-1805
agatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaa

SEQ ID NO: 111271 - DNA, 4905 bp, Homo sapiens
  Payload ID: 1792
  Gene Symbol: BCL2L13
  Gene Name: BCL2-like 13 (apoptosis facilitator)
  ENST ID: ENST00000337612
  CDS Start-End: 354-740
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111272 - DNA, 4458 bp, Homo sapiens
  Payload ID: 1792
  Gene Symbol: BCL2L13
  Gene Name: BCL2-like 13 (apoptosis facilitator)
  ENST ID: ENST00000355028
  CDS Start-End: 127-642
gccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaa

SEQ ID NO: 111273 - DNA, 2677 bp, Homo sapiens
  Payload ID: 1792
  Gene Symbol: BCL2L13
  Gene Name: BCL2-like 13 (apoptosis facilitator)
  ENST ID: ENST00000399777
  CDS Start-End: 1-115
tcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaa

SEQ ID NO: 111274 - DNA, 1381 bp, Homo sapiens
  Payload ID: 1792
  Gene Symbol: BCL2L13
  Gene Name: BCL2-like 13 (apoptosis facilitator)
  Uniprot ID: Q9BXK5
  ENST ID: ENST00000399782
  CDS Start-End: 740-1345
tcctaaactgggatcttgggtaggaggaagaaaagataaggagttcctctatctgaaattagtcgggctgttttgaggagtactggttagataccttccgatactcctccaaagaactctcggattcaagtaaacaaacatccattaatacaagttaagtatgttccaggcgctgtgtgttccaggtactgttaacaaaagcgggttactagttaagacttccttcatgccctggcgcctctgctcagccagttcccttcgcctaggaggacctctctacaccaccccgctatattccctccccggaattccttcccaaccttcaaggaccatctgccccaactagtggcgaacatcgaggctgtcgtgactgtgtagatacttatttgacctgctcccttggcaaacacttgaaacgcaatacatgtttgtggaactgaacatagcctgtgcatgcagcaaggcttctttccctggaatcgcctgcccttcctccaacacagcgaccagccggtcagaatcccaacccctcgactccggaaatgatctgagagacggaacttccgaacgtcgcaatcagatttgggcgggctaggagggtttgggtcttcaggtcacatctggacggagagacctccggggcctccgttggtcggtccttccgctccggataccgttccggatgtcaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaa

SEQ ID NO: 111275 - DNA, 5062 bp, Homo sapiens
  Payload ID: 1792
  Gene Symbol: BCL2L13
  Gene Name: BCL2-like 13 (apoptosis facilitator)
  Uniprot ID: Q9BXK5
  ENST ID: ENST00000418951
  CDS Start-End: 770-1741
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccaattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111276 - DNA, 2112 bp, Homo sapiens
  Payload ID: 1792
  Gene Symbol: BCL2L13
  Gene Name: BCL2-like 13 (apoptosis facilitator)
  Uniprot ID: Q9BXK5
  ENST ID: ENST00000493680
  CDS Start-End: 166-771
ggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctgggtatgagctgttatatattaaaaatattttcttgaaaaaaaattaggtttgttgtttttcttaagagatgggttcttgctgtgttacccgggctggagtgcagtgtctaattgctggcactatcatggcaggcttcggtctcaaactcctgggctcaagtgatcctgcctcaggtcctgaatagccaagagcacaggctgggactataggtgcccaccactgtgccgtgctctatcccgtactttttgatatgtaattattattattattcagttggttcagttgtttataaattttccttatatgttctttgacccttgaattacttagaaatgtattttttaatttctaaatacttacaggtttaaaaattttgttttcaattactaatttaattctgtttcatcagaaagcacgaccatcgtggcattgaaacttgagttatagcctactatcatgatcaatttaaaaaatatatatatagggctgggtgcagtggtgcacatctgtaatcccagtgctttgggaggctgaggtgggtgaatcacctgaggtcaggagttcaagaccagcctggtcaacatgacaaaaccccatctgtacaaaaaaatacaaaaaattaactgggcttggtggcatgtgcctgtaatcccagctactcaggaggccaaggcaggagaatcacttgaacccgggaggcagaggttgcagtgagccaagatggcaccactgcattccagcctgggcaacagagcaacaacaacaacaacaacaaaatatatatatacacacacacacacacatatgtatatgtatatacacacatgtatatttttatgtatgtttcagaacatgtattctctaatggttggtgcagaagtctgtacgtgtccatttacatttaatcagtcttaataatacgtattttaaatctttcagtcatttccaattattttgtctaattatttactaagagagacatgttctatttgctactatggtggtagattttccattttccctttagttctgtcaattgtaggtgactaaaagttgtaattattgacccctggacatttatgcggactctctttctttctttgggcctagaaatggtttttaagtttatttgttgtaatttgcccaacagtcagtgattctgtagagagagtacttttcataaagtatactactcattattgttttttagccactatgcatctgagggtttgagttaatttttaaaatatgtaaatttaattactatggatactaatatcgaacatcctaggtttacgtgcttggtaaatgcttactgaataaaatcctgaacatttgtcttaggaa

SEQ ID NO: 111277 - DNA, 2662 bp, Homo sapiens
  Payload ID: 1792
  Gene Symbol: BCL2L13
  Gene Name: BCL2-like 13 (apoptosis facilitator)
  ENST ID: ENST00000498133
  CDS Start-End: 197-433
acgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaaggccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactg

SEQ ID NO: 111278 - DNA, 4975 bp, Homo sapiens
  Payload ID: 1792
  Gene Symbol: BCL2L13
  Gene Name: BCL2-like 13 (apoptosis facilitator)
  Uniprot ID: Q9BXK5
  ENST ID: ENST00000543133
  CDS Start-End: 683-1654
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaaggccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111279 - DNA, 4797 bp, Homo sapiens
  Payload ID: 1792
  Gene Symbol: BCL2L13
  Gene Name: BCL2-like 13 (apoptosis facilitator)
  ENST ID: ENST00000538149
  CDS Start-End: 354-632
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111280 - DNA, 4817 bp, Homo sapiens
  Payload ID: 1792
  Gene Symbol: BCL2L13
  Gene Name: BCL2-like 13 (apoptosis facilitator)
  ENST ID: ENST00000611738
  CDS Start-End: 111-1496
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111281 - DNA, 4761 bp, Homo sapiens
  Payload ID: 1792
  Gene Symbol: BCL2L13
  Gene Name: BCL2-like 13 (apoptosis facilitator)
  ENST ID: ENST00000616863
  CDS Start-End: 354-596
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggttttacacatccataagtagacctttttggagcctcaccagccaattcaatggcgtcctcttctactgtgcctctgggatttcactatgaaacaaagtatgttgttctcagctacttgggactcctctctcaagagaagctgcaagagcaacatctttcctcaccccaaggggttcaactagatatagcttcacaatctctggatcaagaaattttattaaaagttaaaactgaaattgaagaagagctaaaatctctggacaaagaaatttctgaagggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111282 - DNA, 4961 bp, Homo sapiens
  Payload ID: 1792
  Gene Symbol: BCL2L13
  Gene Name: BCL2-like 13 (apoptosis facilitator)
  ENST ID: ENST00000618481
  CDS Start-End: 111-1640
gcaatcagatttgggcgggctaggagggtttgggtcttcaggtcacatctggacggagagacctccggggcctccgttggtcggtccttccgctccggataccgttccggatgtcaggtagttcaggtcccgccccgacgccggccgtgacgaaggcacgccggggtgacctcaccctccaacatggcggcggcggtagattagggccgcgggtcggagcactcaccgccgctgggggaccctgtcggaagcaactgccgccgccgcctctttcatctcttctggggcaggggccagggccaggggttcaactagatatagcttcacaatctctggatcaagaaattttattaaaagttaaaactgaaattgaagaagagctaaaatctctggacaaagaaatttctgaagccttcaccagcacaggctttgaccgtcacacttctccagtgttcagccctgccaatccagaaagctcaatggaagactgcttggcccatcttggagaaaaagtgtcccaggaactgaaagagcctctccataaagcattgcaaatgctcctgagccagccagtgacatatcaggcatttcgggaatgtacactggagaccacagttcatgccagcggctggaataagattttggtgcctctggttttgctacgacaaatgcttttggaattgacaagacgtggtcaagaacctttgagcgcactgctgcagtttggcgtgacatacctggaggactattcggcagagtacatcattcagcaaggtggctggggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcctgaagaagtgaaaagcttagacagcaacggagctggagagaagagtgagaacaactcctctaattctgacattgtgcacgtggagaaagaagaggtgcccgagggcatggaagaggctgctgtggcttctgtggtcttgccagcgcgggagctgcaagaggcacttcctgaagccccagctcccttgcttccacatatcactgccacctccctgctggggacaagggaacctgacacagaagtgatcacagttgagaaatccagccctgctacatctctgtttgtagaacttgatgaagaagaggtgaaagcagcaacaactgaacctactgaagtggaggaggtggtccccgcactggaacccacagaaacgctgctgagtgagaaggagataaacgcaagggaagagagccttgtggaagagctgtcccctgccagcgagaagaagcccgtgccgccgtctgagggcaagtctagactgtcccccgccggtgagatgaagcccatgccgctgtctgagggcaagtctatactgctgtttggaggggctgctgctgttgccatcctggcagtggccatcggggtagccctggctctgagaaagaaataggaggcttttcagaagagaaagacagaaggatgtaaggttggagttgtattggctggaatttgaacctccagcagctgtctggacatttgtggaacactctgggataattggggacttctgctcaacatggcagtggcatgttaggcatgttagggcttgaggtggggcattcacattcatctgactgtaaatcccaagggcctccgctcatgctaaattgagaatcttaggggtaaagcaccccctccaggaccgggtttctcagccttggcactagtgctgttctgaccattctctgtgttggggctgtcctgtgtgtggtgggctccacccactagatgccagtggcaccccctcccagagatgacaaacgaaaatgtctctagacattgccaaatgtcccgtgtgaacatcccctattgagacccactgctttagcgagagagggtttacttaggaagaattgggatagaaattcccagctgagagaacttagctgtgggctcctcagctactgacttcttagctcttaatccccttagaatttcatctttctcgatgagcaggctctgcacccactctttttttgccccccgccctcatcctggagtgtgagggtgctcgcccgtactctcagctgcctctcagggactgcactgttcctcttcacccccaggttcctgctaagatcccacgggcgagggcttgctctggactcagtctgtcaagtccccgaagcttcctgcagctccaccttgtaaaaatgctgcctttgggaatcttcgaaatatgtacacagagaaaatcacatgaaggagacctggggtccccacttgtgagtgcaactgcaagtaactctggctagagagacacatgtgtcttgtgtcaaggcaggaggataacctggatgaccttctgaggtctcttcagcccttttcgctagtggtcacccaccaccatggttacttgccagcaacatctctattgctggatggtccctgtctataaccttgggctagtatattttttccaatatgggaccttagtcttactactgatgagttctatgggtctcttgctagggggtaaggatttttattcttgggcttatagagccagttagatcataattcttatgaaatagagagtgtcctaaatatcactgaaataaaaagtaggaaaaagaagcttgaattttaagactgaggctgctctgcagattctagtttggctttcagagttcaagagtggtggcatcttcacctgaattcttcaatgccagggtaataaaccaaaatagtcctaatcagtatatgctagttgagcatcggcataattttctttcctctggctgatcccagccctaaaggaagggtagacccgtgtctttccagccctaaaggaagggtagacccgtgtctttccagccctaaaggaagggcagacccgtgtctttccatgcccgagggccacgacgtcactatgcagggcacacgtggcttggtttaaaaaggtcatcttagatttatcttagtaaatgtaataaattattttttagatcttgaaatttataataaaaatactttacctaccctgatcaccaaaacctgatgttttaaatgtgctttctttttgaaatttatgttttcaaataaaatctccctaaagcaatatttaaaaattggtcaaaacaaggtctgggagtatgtttgtgtgtctttccagctttatcctgtagcgtgtctttgttctgtgttttagtgtcccatttagggagtgatgttttaagggtttttgtgtacttggattaagtaattagaggtgagtggggggaatgggattattgaggcaatgatttttttcttcatgggctctgatagttgcattgattgttctgtattctaattgctatatttgtgtttgcataggtgaagagcaaactggtgcgttatcttgatttttaaaaagtaataaatcctatgagttccagtattaacacttgccagttctggatcctcacacccattggctgagcgcattcaagcaccaatcgaagccaggttcatctctgagctgctgaaaggaggtgtgaggcttaggaaattggagcctgtgttgcccacgaaaggaaagaataaggaagaaatgtggtatggaagcggctacttgctgctttattttcccacctgttagacattcctccacagtgatttggccagttgtatttcacggtaatggaactagatagtgttttccattggctttctctggtagctcttggtcagctcctgagttaacaggatgtggcagcatccctgttcttccttcacgtcctcaccctctgcctccagcagtggaagggaacagccctcatgaggactgcttcctactgcagctcctgctttttgctcatacatttaaaaaactatttctcaagcttcccctccttttggggggaggagctgatagtaggaggccattccttccacctccaacttataccctctaagtctaaggtgaaggaaagattcagaataaatccaacttgtttatagaaaagttcttgttagtccttagacctcatctcaactgctctgttgaaggtaatgatttattggggggaaaaaacaacgccaatttatcctctctgtattaaagtgataattctgggcccacagaaatcagtcagtacctgcggtgtgccttaaggggactctcatgatcatcattcccttctagagaacattctagatgaagaaatgcaactgttgaccttctggttcacccatctccccctcgaggcattcttgataccccttctcacctgcatttctgtcccagggataccagatgcagccactacctaactaggcttgtcctgggggagtgagccgtgaacctggagacatggctttgacccacagctactgttcatttcctcaggctttgcgctgattccctcaataatatgacagtaaggcaagtagtctccttgcctttctcctgaaaggtatgagatgtggacatttcagtgtttgaattattttaagagatgttttatagaaataaaacgttttgtagctaagaattttccctttctcttaatttcttacatctttccacacaaacttatctttccaagaatttgaggtggtgatcatacccatcaagacggccttgtaggctatctgattgctaacagacacgacctagagcttctgcccaaattcccacacaagcattatctcgtttaacatctcagcgacatactggataccagaataatgtttcctcttctctggtgcaccaaaacctgccctt

SEQ ID NO: 111283 - DNA, 2039 bp, Homo sapiens
  Payload ID: 1793
  Gene Symbol: BCL2L14
  Gene Name: BCL2-like 14 (apoptosis facilitator)
  Uniprot ID: Q9BZR8
  ENST ID: ENST00000266434
  CDS Start-End: 196-954
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggacactgccttcatccccattcccttggttgacaccagcatccagggttttccacaggatggtttgatggcctgcatttgagctaaagaatgaacttctgtctgcctcgtggagccaagctactgtactgagtgcttattcttttgtacacagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaa

SEQ ID NO: 111284 - DNA, 1247 bp, Homo sapiens
  Payload ID: 1793
  Gene Symbol: BCL2L14
  Gene Name: BCL2-like 14 (apoptosis facilitator)
  Uniprot ID: Q9BZR8
  ENST ID: ENST00000298566
  CDS Start-End: 8-838
gcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaaggaaaaagaatgggaggagtcagcaaagaccaagataaaaatggcacttctctggaggagcagtggtggtggacccagagttctgagtatacctgaggcatttatgaagaacagcttcactctcaccccacctggcttctcagaacacaattagaaaaaatgactgactcaccccaaggtgtccaaaagccccaaacaagcatttgggaatagtccctaacttggcagcagcctcaagttcagtacaagatacccggcagagagagagcactgctttttcattgtttgcactgctgtcaaatcctactcttcaactaccatctctggactcacagcttccaccctttcacacaattcatgtcatcagacagagaaagtagattaggctttaagtgaagaggagtttgaagaatttacggatttctgcttcctaatagaagtgaaaagaaaaaaagaattgtgaagaaatcggacctacttctgcacttcccctctacttgatcatgtgttggtatcatattttaaaaacaagtagaaattaataaaagaggatagtgaaagca

SEQ ID NO: 111285 - DNA, 1897 bp, Homo sapiens
  Payload ID: 1793
  Gene Symbol: BCL2L14
  Gene Name: BCL2-like 14 (apoptosis facilitator)
  Uniprot ID: Q9BZR8
  ENST ID: ENST00000308721
  CDS Start-End: 207-1190
ctcttttcaggctgagtcctaaacctgaagaaagtttagagcctggggctctaaactacctgagtctttccaaacgacaagccaagaagacctgttgaaagtttcctcttaagtttcgtggagagagactcaggtatagaaatatccttactgccacctgacctgaagcagaagaaatcacagacagcttccagaccaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaa

SEQ ID NO: 111286 - DNA, 1886 bp, Homo sapiens
  Payload ID: 1793
  Gene Symbol: BCL2L14
  Gene Name: BCL2-like 14 (apoptosis facilitator)
  Uniprot ID: Q9BZR8
  ENST ID: ENST00000396367
  CDS Start-End: 196-1179
aatgacatgacagccattccgtggccagggacaccactgcccaagctggagaccacgaggattcagggactgaagccagcatgggaattcctggtttgagatcagagtcctgagtacctcgtgggaacttgggcactcatccgcaggaggtctagacccccagagaattccttgagtctaaggcacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagactactgtcaaaa

SEQ ID NO: 111287 - DNA, 598 bp, Homo sapiens
  Payload ID: 1793
  Gene Symbol: BCL2L14
  Gene Name: BCL2-like 14 (apoptosis facilitator)
  ENST ID: ENST00000464885
  CDS Start-End: 426-598
gctttcgcttcatcctagaggctaaatgggctcccctggactcgcctggcagaactaaccacctagaagaacgttattgtaagggggaaatgcaaacagggtgaagacaagaggcataggtgatggacactaaaacaaagaccctgccacccaccgggagggaagtgaaatctcacctcaacaagtgagtccgcagagcgagaaccgtgcgacagtgcgtctgccaatacctggaatgtaggtgttcgttgcagtgtggccttcccagccggcctctcagcacacccggccaggcagccagtgttcccagaggacacgctggggccagacgtggaggaccccggccacctcggggagggaaagagaccaagaaaagaacctctgtagccttgcttctgagagtgcaggtttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcct

SEQ ID NO: 111288 - DNA, 762 bp, Homo sapiens
  Payload ID: 1793
  Gene Symbol: BCL2L14
  Gene Name: BCL2-like 14 (apoptosis facilitator)
  ENST ID: ENST00000461264
  CDS Start-End: 388-762
gggctcccctggactcgcctggcagaactaaccacctagaagaacgttattgtaagggggaaatgcaaacagggtgaagacaagaggcataggtgatggacactaaaacaaagaccgaagttcatgtttggagagatggagtaacctgccacaggtcacaaaactagtcactggcatggccacaatctgaatttgggactgttagactgagaagcccaagctaattcttgatacgctcactgcctgggacatttcacacggtagatctgagctttctcgcatctgagactaaaaggaaaatgtagtccttaacagacagcagaaggaaacagattattagcaaaaagaactgctttcctagcaggaaaccagagaaggagttatttcatgcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaatac

SEQ ID NO: 111289 - DNA, 583 bp, Homo sapiens
  Payload ID: 1793
  Gene Symbol: BCL2L14
  Gene Name: BCL2-like 14 (apoptosis facilitator)
  ENST ID: ENST00000588270
  CDS Start-End: 54-583
aagtggccctgcatagaagggcacagtgtggactttgttgttacaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtc

SEQ ID NO: 111290 - DNA, 1927 bp, Homo sapiens
  Payload ID: 1793
  Gene Symbol: BCL2L14
  Gene Name: BCL2-like 14 (apoptosis facilitator)
  ENST ID: ENST00000586576
  CDS Start-End: 149-1231
agtgctttcgcttcatcctagaggctaaatgggctcccctggactcgcctggcagaactaaccacctagaagaacgttattgtaagggggaaatgcaaacagggtgaagacaagaggcataggtgatggacactaaaacaaagacctgatggggttatcaccatgttgcccaggctggtttcaaactccaggacacagtctgtcctcctgcctcagcctcccaaagcgctgggattgcaggcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagac

SEQ ID NO: 111291 - DNA, 1850 bp, Homo sapiens
  Payload ID: 1793
  Gene Symbol: BCL2L14
  Gene Name: BCL2-like 14 (apoptosis facilitator)
  Uniprot ID: Q9BZR8
  ENST ID: ENST00000589718
  CDS Start-End: 171-1154
aaagattctaaggtcccagtgctttcgcttcatcctagaggctaaatgggctcccctggactcgcctggcagaactaaccacctagaagaacgttattgtaagggggaaatgcaaacagggtgaagacaagaggcataggtgatggacactaaaacaaagaccgcccaacatgtgtagcaccagtgggtgtgacctggaagaaatccccctagatgatgatgacctaaacaccatagaattcaaaatcctcgcctactacaccagacatcatgtcttcaagagcacccctgctctcttctcaccaaagctgctgagaacaagaagtttgtcccagaggggcctggggaattgttcagcaaatgagtcatggacagaggtgtcatggccttgcagaaattcccaatccagtgagaaggccataaaccttggcaagaaaaagtcttcttggaaagcattctttggagtagtggagaaggaagattcgcagagcacgcctgccaaggtctctgctcagggtcaaaggacgttggaataccaagattcgcacagccagcagtggtccaggtgtctttctaacgtggagcagtgcttggagcatgaagctgtggaccccaaagtcatttccattgccaaccgagtagctgaaattgtttactcctggccaccaccacaagcgacccaggcaggaggcttcaagtccaaagagatttttgtaactgagggtctctccttccagctccaaggccacgtgcctgtagcttcaagttctaagaaagatgaagaagaacaaatactagccaaaattgttgagctgctgaaatattcaggagatcagttggaaagaaagctgaagaaagataaggctttgatgggccacttccaggatgggctgtcctactctgttttcaagaccatcacagaccaggtcctaatgggtgtggaccccaggggagaatcagaggtcaaagctcagggctttaaggctgcccttgtaatagacgtcacggccaagctcacagctattgacaaccacccgatgaacagggtcctgggctttggcaccaagtacctgaaagagaacttctcgccatggatccagcagcacggtggatgggaaaaaatacttgggatatcacatgaagaagtagactgaaatatcagatttgtcatcaggaatactctttgtctactgtggtcctgtgcacgttggcctcagatggactacaggagattacaacgtacaaggcagatggagcattgacgttttcaaaaccattattcctgtgactggagaggcatcaggagaggtctcgttcgtctccagctcataaaatgtagcagcatcatccttgacagtgatgtttttcaggccctccattgagaacctgaggaaatctgtaaagataagtggtgatgttgtttcaaacgttcagaacagataccatcatcctgcctttgttagctgctgtagggaaagtgcgttacagatgtctgctgacctcacaagagtgaaaagataaactgtgcatgtgtttccacttccgtttctagtactatttatttttaaactacacttggggtggcctaatacctaggaagatgttgctattcacgttagtaaacagcctaaagaaactcttaggtttactgctacatccatttgtttggagaggtaactgttgtctgtgcctttttgaaaaacttccatttggtacaaaatttttactccaacaccccctcaacccttttctcagggaccacacctcttcttcccaaggtccctgggacttcctcattctttgtggtagtacaatgattggtagcaggtaaaataaatacatagaaagac

SEQ ID NO: 111292 - DNA, 1247 bp, Homo sapiens; identical to SEQ ID NO: 111284
  Payload ID: 1793
  Gene Symbol: BCL2L14
  Gene Name: BCL2-like 14 (apoptosis facilitator)
  Uniprot ID: Q9BZR8
  ENST ID: ENST00000628315
  CDS Start-End: 8-838

SEQ ID NO: 111293 - DNA, 1850 bp, Homo sapiens; identical to SEQ ID NO: 111291
  Payload ID: 1793
  Gene Symbol: BCL2L14
  Gene Name: BCL2-like 14 (apoptosis facilitator)
  Uniprot ID: Q9BZR8
  ENST ID: ENST00000627413
  CDS Start-End: 171-1154

SEQ ID NO: 111294 - DNA, 583 bp, Homo sapiens; identical to SEQ ID NO: 111289
  Payload ID: 1793
  Gene Symbol: BCL2L14
  Gene Name: BCL2-like 14 (apoptosis facilitator)
  ENST ID: ENST00000627464
  CDS Start-End: 54-583

SEQ ID NO: 111295 - DNA, 2039 bp, Homo sapiens; identical to SEQ ID NO: 111283
  Payload ID: 1793
  Gene Symbol: BCL2L14
  Gene Name: BCL2-like 14 (apoptosis facilitator)
  Uniprot ID: Q9BZR8
  ENST ID: ENST00000631251
  CDS Start-End: 196-954

SEQ ID NO: 111296 - DNA, 1927 bp, Homo sapiens; identical to SEQ ID NO: 111290
  Payload ID: 1793
  Gene Symbol: BCL2L14
  Gene Name: BCL2-like 14 (apoptosis facilitator)
  ENST ID: ENST00000628217
  CDS Start-End: 149-1231

SEQ ID NO: 111297 - DNA, 1897 bp, Homo sapiens; identical to SEQ ID NO: 111285
  Payload ID: 1793
  Gene Symbol: BCL2L14
  Gene Name: BCL2-like 14 (apoptosis facilitator)
  Uniprot ID: Q9BZR8
  ENST ID: ENST00000631317
  CDS Start-End: 207-1190

SEQ ID NO: 111298 - DNA, 762 bp, Homo sapiens; identical to SEQ ID NO: 111288
  Payload ID: 1793
  Gene Symbol: BCL2L14
  Gene Name: BCL2-like 14 (apoptosis facilitator)
  ENST ID: ENST00000625808
  CDS Start-End: 388-762

SEQ ID NO: 111299 - DNA, 1886 bp, Homo sapiens; identical to SEQ ID NO: 111286
  Payload ID: 1793
  Gene Symbol: BCL2L14
  Gene Name: BCL2-like 14 (apoptosis facilitator)
  Uniprot ID: Q9BZR8
  ENST ID: ENST00000628783
  CDS Start-End: 196-1179

SEQ ID NO: 111300 - DNA, 598 bp, Homo sapiens; identical to SEQ ID NO: 111287
  Payload ID: 1793
  Gene Symbol: BCL2L14
  Gene Name: BCL2-like 14 (apoptosis facilitator)
  ENST ID: ENST00000629515
  CDS Start-End: 426-598

SEQ ID NO: 111301 - DNA, 1084 bp, Homo sapiens
  Payload ID: 1794
  Gene Symbol: BCL2L15
  Gene Name: BCL2-like 15
  Uniprot ID: Q5TBC7
  ENST ID: ENST00000393316
  CDS Start-End: 173-664
cctttctgagcagctgtgtttgaagaaagctagtgggaaaagttccaggattacatgtcaggaaactacaagaggtagaaacatttgttgatttaccagtgtttttaacttcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtggctatcattgctggtcgccttcggatgttgggtgaccagttcaacggagaattggaagcttctgccaaaaacgtcattgcagaaaccattaagggacagacaggagctatactccaggacactgtggaatctctcagcaagacctggtgtgctcaggattccagcttagcttatgagagagcttttctggcagtgtcagtgaaacttcttgagtacatggctcacattgctcctgaagtagtgggacaggtggctatccccatgacgggtatgatcaatgggaaccaagccatccgggagttcatccagggccagggaggttgggaaaatctggagagctgaagagttggagctattcacgagactgaacatcacttccttgttgactgattgggtgattgattcctgggaattcaaacaaacaaataaaaaagcacttttttcattttatcagaactgaacttagctgaataagttattttttactgattgttaaagttgggagcagctgccagaggcctgcagagttggtttttgttttgttttgttttgtcaacttaatgcaaaccacagagattttctactttctgttttcacatgagttttaatgaggttctgttgaagcaaagacccctagacacaaagtaatgacttgttagtagtggaattataagcaacagggcaggcctttgctggaggtattttgagagaaagggagaacaatggaaactatttcttcagatgtagccctgtcttttggta

SEQ ID NO: 111302 - DNA, 276 bp, Homo sapiens
  Payload ID: 1794
  Gene Symbol: BCL2L15
  Gene Name: BCL2-like 15
  Uniprot ID: Q5TBC7
  ENST ID: ENST00000393320
  CDS Start-End: 63-233
tcctgctgggctgaaaactgcttgtttcgtggaaaagcaaaacttgacagcaaacatctaaaatgaagagctcccaaacttttgaggaacaaacggaatgcattgtgaacactctactcatggacttcttgagcccaacattgcaggttgccagccggaacctatgctgtgtagatgaagtagattcaggaaaatctggagagctgaagagttggagctattcacgagactgaacatcacttccttgttgactgattgggtgattgattcctggga

SEQ ID NO: 111303 - DNA, 267 bp, Homo sapiens
  Payload ID: 1794
  Gene Symbol: BCL2L15
  Gene Name: BCL2-like 15
  ENST ID: ENST00000471267
  CDS Start-End: 1-267
atgaagagctcccaaacttttgaggaacaaacggaatgcattgtgaacactctactcatggacttcttgagcccaacattgcaggttgccagccggaacctatgctgtgtagatgaagtagattcaggagagccttgttcttttgatgtggctatcattgctggtcgccttcggatgttgggtgaccagttcaacggagaattggaagcttctgccaaaaacgtcattgcagaaaccattaagggacaggaaaatctggagagctga

SEQ ID NO: 111304 - DNA, 3605 bp, Homo sapiens
  Payload ID: 1795
  Gene Symbol: BCL2L2
  Gene Name: BCL2-like 2
  Uniprot ID: Q92843
  ENST ID: ENST00000250405
  CDS Start-End: 230-811
atcacccggcgccgggccctccctctgcccccccctttctcctccctccttccttccctcccttcctccctctctccctccctcccagctcctgcaccaggaaacggcccggatcccggcagcggcctgacccggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtaactgtaggggccttttttgctagcaagtgaaagtccagggccaggtggggctaggtgtggctgggggccaggagagcaggaacagaacagagaaatgcccttggaagaagtggagttggtggatgggtgggcatggaacaggatgggcagagaaagggtagtgtgtgagggagctgagtaggccaggtaggcgattggaagagtgagcaggacacagaggggaggggaatgttttggcaagtttaggggcacaggagatgtagtcgttccagggctgggggaggtgggagggatcacgcctataggtgtgggcacatgaaacgacctggaacttgcttcacagccctgaggaaggtggacttacataagcagctgtattccattagatgagtgggatttagggaacgcagaaggcacatccctttggaatggaagcttaggggttctcaggtgatagggagaggtggctgttaacagtgggctgcttggacacgcgtgtgcatgtgcacgcatgctggtgtgcatgctgggctgcctggcaaatctggtggtgatgggattcctcaaggagaaaacattccctcttgcaatggcaagaactaggggcagttctctgtccctcctcccaacccctcctttcccctgcccttgtcctgatgcctcaaggcttagagagaaacattgtatccagaccgagggctctgctgcttctttccagaaagtgattggcaaggctttggagagaagagcagttctgcagctggccttgttccttcatcatcccccttccttgtgcattatgcacttgctgctgcctcctgggctctgatagaagggcagggctgttgagcctggatgggtggaggcttaggtagccggacctgcctgccaccctcctctcccactcaggcacaatggtgcctaaagtgtttccaatctctgggacctctgtacccaaactgaaactctaaattggggccctaactaattttccttttgaggttgtgggcataagtgctgatctagaatacagtctgggtcccacactgtgtctcagtgagactgttgatgccttgagatgaccatttcagatctgaatcccatgggtgtgagggtgatgggtactccaggactggcctatgctgtgttgtgggctttggttcggctttatcaggggccaggcatatgggttctagagtacctaccatgacctagaagcatttatgatttatttgaagccacactgtttgcatgggtgttacttgtctgtacctcagagtctgaggatgttaactttggaactcgcagtcctctagaacagcttcagattatggctttttcttttgaggaagaaattattcactccagatgcatgccctgagccagacctcactgctgcactttccaaggtgctaagattgctgctctccaatgctaactttctgacacagtgctctagaaccctgcctgtggtcctgagcactgatcaccttagctagaccatggttgactcttcttggagattttcacttggtcctagaatgtggcaacgtagttgtgctcgccagaacgtgggaccaaattggcctcaggtgttgagtccagacttctgcttttgagagagggctgcactttttcatggtatttctaggggaggtggtaggctgcatgtgccacttggtcttgttgtgagtatgctgacaccagaaactcagagccagcttgtggcaagcagttggggtggggggtctctgacttgctcaggacaaactaggccagtggttttcaaactgcttggcagagccctgaagtttcctaggggttgcctcaggagtccttggggagatgaagggggtggggagctgagcaggctgggcaatttgccctcaaacagaacagctccccttgtagctgtcttacatattggggttcagggtaagattttatttgcattaaggggtttgctgctgaaaaaaagttggaaaaccactgactagaccatcggctccaaattggagtctgtgcttccttccccaggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggtaaagggcttggtctggattcccagaagcatagcttagatgggaccacagtgggcaattttgacctgtcctgcccttcttagcttgaagggaaaccccagagactcttctgtcagggaaaactagggactctcttctagagccatatagttccttgggattagctcttggccaagaaggctgagtatggttcccaatttttaaatccatttcattttttaaaaaataagggaaataaatgtaattgccatttttcaaagattaagtaggaggagaggggtttcttgctctccagagcccaaagggacaaatagggactttgtttaggccaaggaaggagcggaagtagggcaactcggtcctgcgattattaatcccactccccacttattctagggcacacaaacactattttacttttttaaaatcataaaacggcagaacagatttggttagtttagaagaaaagaaagctctataaatataaatctatattcctgtatttttatttaataatttataaataccaagttcatttgacttttatttttgtgtaatatgtaatgatcgtattaaaaacaataaataaagcccagaagtttaatgagaaggactgaa

SEQ ID NO: 111305 - DNA, 548 bp, Homo sapiens
  Payload ID: 1795
  Gene Symbol: BCL2L2
  Gene Name: BCL2-like 2
  ENST ID: ENST00000553824
  CDS Start-End: 394-548
gatccacatggtacatgacattcttcctgttttcttcacaagacaaggatgatgtttaaatgggcatttgtttgcggaatgacttggagagttcctctctttcagccatcttttctcaaagactaaggctgtggacaggatgggcatgaagactgtcaaggagcccgagtgagggaagcagaccaaccatggtcttggagaaaagaaaatagggtttccatcccttctggagggagaaggaatagcagagatgaacatgaatgaagaaggaaacaaatggaaataaacaaaatgaagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatga

SEQ ID NO: 111306 - DNA, 548 bp, Homo sapiens
  Payload ID: 1795
  Gene Symbol: BCL2L2
  Gene Name: BCL2-like 2
  ENST ID: ENST00000556599
  CDS Start-End: 1-502
gcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagctctatacggggacggggccctggaggaggcgcggcgtctgcgggaggggaactgggcatcagtgaggacagtgctgacgggggccgtggcactgggggccctggtatggagcacactcttcaccctaccctctaccacaggacacatatccctgttagcattccccgggacctttagccaagaggagctgcagggaccatggccaggttaccaaaatgccctgctctgaagccttgacacctgggtggaaagagaggctgttttctgaaagggta

SEQ ID NO: 111307 - DNA, 545 bp, Homo sapiens
  Payload ID: 1795
  Gene Symbol: BCL2L2
  Gene Name: BCL2-like 2
  ENST ID: ENST00000554635
  CDS Start-End: 331-545
agctgggcctttgggctgcactagggggaaccgggaatagagatggtgtcggcaggaagcccttggccttgggtttcccgggaggacagtcattaaacatggattcggccacacagctggtagagcgttgggggcaggggcctaggcccagagctgcaaccctagcccttcccaggccagaacctgatccctggccttcccctcctggttctgatctccccctcccctttccagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgacccc

SEQ ID NO: 111308 - DNA, 631 bp, Homo sapiens
  Payload ID: 1795
  Gene Symbol: BCL2L2
  Gene Name: BCL2-like 2
  ENST ID: ENST00000557236
  CDS Start-End: 185-631
aggaaacggcccggatcccggcagcggcctgacccgtgagatccctaacctggcaggcgggcggggttggagactggctgaggtggggggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgggcggagttcacagct

SEQ ID NO: 111309 - DNA, 596 bp, Homo sapiens
  Payload ID: 1795
  Gene Symbol: BCL2L2
  Gene Name: BCL2-like 2
  ENST ID: ENST00000557579
  CDS Start-End: 165-596
atcccggcagcggcctgacccgtgagatccctaacctggcaggcgggcggggttggagactggctgagggctccacgctggccaggaggatgaaaggccccagctgggggctccttgccaccagtgctgtgtcttaagagctgccatcccggctggccgcccggatggcgaccccagcctcggccccagacacacgggctctggtggcagactttgtaggttataagctgaggcagaagggttatgtctgtggagctggccccggggagggcccagcagctgacccgctgcaccaagccatgcgggcagctggagatgagttcgagacccgcttccggcgcaccttctctgatctggcggctcagctgcatgtgaccccaggctcagcccaacaacgcttcacccaggtctccgatgaactttttcaagggggccccaactggggccgccttgtagccttctttgtctttggggctgcactgtgtgctgagagtgtcaacaaggagatggaaccactggtgggacaagtgcaggagtggatggtggcctacctggagacgcagctggctgactggatccacagcagtgggggctgg

SEQ ID NO: 111310 - DNA, 2657 bp, Homo sapiens
  Payload ID: 1796
  Gene Symbol: BOK
  Gene Name: BCL2-related ovarian killer
  Uniprot ID: Q9UMX3
  ENST ID: ENST00000318407
  CDS Start-End: 303-941
agaaggccaagccccaagcccagcctctcgccagctgggagtcgcgcgctgcccacctcgctgcccaggcccccgacgccgcggcaggagccccccaagagcgcgggaagccccgtggacctggcgctcccggctcgggcgtggacggggcgggcgccggggcggggcgcgcgtcctcgcgggtctgaatggaagggtcgaggtcgtcgtcggcggcgagcagatcctgaagccagaactccaccccggcgcccgcgccatgcggcgggagaggtgcggcgccccccacccgcgtcgccgccatggaggtgctgcggcgctcctcggtcttcgccgccgagatcatggacgcctttgaccgctcgcccacagacaaggagctggtggcccaggccaaggcgctgggccgggagtacgtgcacgcgcggctgctgcgcgccggcctctcctggagcgcgcccgagcgtgccgcgccggtcccgggacgcctggctgaggtgtgcgcggtgctgctgcgcctgggcgatgagctggagatgatccggcccagcgtctaccgcaacgtggcgcgtcagctgcacatctccctgcagtctgagcctgtggtgaccgatgcgttcctggccgtggctggccacatcttctctgcaggcatcacgtggggcaaggtggtgtccctgtatgcggtggccgcggggctggccgtggactgtgtgaggcaggcccagcctgccatggtccacgccctcgtggactgcctgggggagttcgtgcgcaagaccctggcaacctggctgcggagacgcggcggatggactgatgtcctcaagtgtgtggtcagcacagaccctggcctccgctcccactggctggtggctgcactctgcagcttcggccgcttcctgaaggctgccttcttcgtgctgctgccagagagatgagctgcccacctggcagtggccgcagcctggccctctgggcccaacgcaggaggccctcagcacccgaacacatcttcctcctccccacccgagcctggagcactctaaccctcggagaccccctaagccccgttcctccgcagacccaggccctccggaaggggtgagtggggaggggctttcctgagcctggagctgggctttggggcagcctgcgaccctccccgcttgtgtcccttctcctgtgatctctgtgttttcccttttctttctggggccaggaagtcagggtcaactcccaggcctcagatgcaggggcccagaacacctgctctcacctgagccccaggtgaaggggcccgggaacacctgctctcacctgagccccaggtgaaggggcccgggaacacctgctctcacctgaaccccaggtgaaggggcccggaacacctgctctcacctgagccccaggtgaaggggcccggaacacctgctctcacctgagccccaggtgaaggggcccgggaacacctgctctcacctgagccccaggtgaaggggcccgggaacacctgctctcacctgaaccccaggtgaaggggcccagaacacctgctctcacctgagccccaggtgaaggggcccggaacacctgctctcacctgagccccaggtgaaggggcccgggaacacctgctctcacctgagcccctggtgaaggggcccggaacacttgctctcacctgagccccaggtgaaggggcccggaacacctgctctcacctgagcccccggtgaaggggcccggaacacttgctctcacctgagccccaggtgaaggggcccggaacacctcctctcacctgagccccaggtgaaggggcccggaacacctcctgtcacctgagccccaggtgaaggggcccgggaacacctctcacctgaacccgggggtcccatcccaggaagaagggccatctcaggacatgagtcctcaggggccctgcacattcaatctgaaggtgaccctggcctggctgaagctggaagagctgtggggactcagcctgtaaacagagcgtaaggttcacatgctggttgcttaatccgtttctggaggaagagtatgacacccacttgtgatggggtccttgtgcggtggggaccggggccggcgggctccaggccagcacacctaacccatggatgtggaacctacggccgagaaggaatgttgcatgagtcggatcccagtccattgtcagtggagggtgagggtgaccccatctgctatttttgtgctcatcctcatacaaccatttggggatgtgcctattagggctccgtaagaactcagatgcctgggaagcccagcccctcaggtgcccccacacacagccttcccttgacgcctacatttctaggcacatgtgaggcatctttcctggagccccgagccagccctgtccctccccagtgcagcatggcactcaggagatacaggctggacatggggcagtcgttctggggaggcctggcctagcagccacccacctgagccctcccggccaggcttcgtgctggggtgggccatgtgccaggacaggagggtcccggcggaaagccagccccggactcatcgtgacattgagatcccactggagggtaggggtggtaataaacttctccaaacgatcgttgtcattttagacagaa

SEQ ID NO: 111311 - DNA, 1033 bp, Homo sapiens
  Payload ID: 1797
  Gene Symbol: BCL2A1
  Gene Name: BCL2-related protein A1
  Uniprot ID: Q16548
  ENST ID: ENST00000267953
  CDS Start-End: 328-855
gcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactaggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctatat

SEQ ID NO: 111312 - DNA, 809 bp, Homo sapiens
  Payload ID: 1797
  Gene Symbol: BCL2A1
  Gene Name: BCL2-related protein A1
  Uniprot ID: Q16548
  ENST ID: ENST00000335661
  CDS Start-End: 51-542
acagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggggaaatggcacaatcacacacctatgctggtagagtcagtggcccacaagaagaggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctcta

SEQ ID NO: 111313 - DNA, 6390 bp, Homo sapiens
  Payload ID: 1798
  Gene Symbol: BCOR
  Gene Name: BCL6 corepressor
  Uniprot ID: Q6W2J9
  ENST ID: ENST00000342274
  CDS Start-End: 364-5529
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattg

SEQ ID NO: 111314 - DNA, 6358 bp, Homo sapiens
  Payload ID: 1798
  Gene Symbol: BCOR
  Gene Name: BCL6 corepressor
  Uniprot ID: Q6W2J9
  ENST ID: ENST00000378444
  CDS Start-End: 230-5497
gctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagatgactggcctgagagggaaatgacaaacagttcctctaaccacttagaagacccacattatagtgagctgaccaacctgaaggtgtgcattgaattaacagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattg

SEQ ID NO: 111315 - DNA, 6338 bp, Homo sapiens
  Payload ID: 1798
  Gene Symbol: BCOR
  Gene Name: BCL6 corepressor
  Uniprot ID: Q6W2J9
  ENST ID: ENST00000378455
  CDS Start-End: 364-5475
ggtatttccgaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaa

SEQ ID NO: 111316 - DNA, 2230 bp, Homo sapiens
  Payload ID: 1798
  Gene Symbol: BCOR
  Gene Name: BCL6 corepressor
  ENST ID: ENST00000378463
  CDS Start-End: 261-2129
atgtatgtgctgtgccttataggaccatgatgcaaggagaaagtggtagacggtgtaggactcagccatgttcacatctgcctagatctcatgaccaaaggcacatggcattccactcacagaagggctgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggaagtcccctcaaatagctagggggagtgttgaagggaaaaaaacagacgacaagaccagtaaaacagacctgtagaaatgatttaagcagaagaggactggtgaagctgaactaccatcaaagctacgagagatcctacacacccagatttaaaaaataataaaaacttaagggca

SEQ ID NO: 111317 - DNA, 6258 bp, Homo sapiens
  Payload ID: 1798
  Gene Symbol: BCOR
  Gene Name: BCL6 corepressor
  Uniprot ID: Q6W2J9
  ENST ID: ENST00000397354
  CDS Start-End: 230-5395
gctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggagaaaattgaa

SEQ ID NO: 111318 - DNA, 4216 bp, Homo sapiens
  Payload ID: 1798
  Gene Symbol: BCOR
  Gene Name: BCL6 corepressor
  ENST ID: ENST00000406200
  CDS Start-End: 355-4216
gaagctggccaggccctctgctgctgaccctggaaatcgggtcacactagacaaggctgcatgtgcggggagaaggcgggggggctcctttgcacgcggctgctcgcgtttccccaaggcctccaaatagtctaaaaactcacctcggaggaggagaaagagcgtgaagtggctctttcgatctgagacaccccctcccggagaactcgccccctcccccccagcccagagcggagtgaaatcttagaagccgtggctgctgggtttgaacggaatgctggagtcagtggaagacggagctggtcggcccgaagactagacgcttgaagcaaagctgccatcccagaagacgacatgctctcagcaacccccctgtatgggaacgttcacagctggatgaacagcgagagggtccgcatgtgtggggcgagcgaagacaggaaaatccttgtaaatgatggtgacgcttcaaaagccagactggaactgagggaagagaatcccttgaaccacaacgtggtggatgcgagcacggcccataggatcgatggcctggcagcactgagcatggaccgcactggcctgatccgggaagggctgcgggtcccgggaaacatcgtctattctagcttgtgtggactgggctcagagaaaggtcgggaggctgccacaagcactctaggtggccttgggttttcttcggaaagaaatccagagatgcagttcaaaccgaatacacccgagacagtggaggcttctgccgtctctggaaaacccccaaatggcttcagtgctatatacaaaacaccgcctggaatacaaaaaagtgctgtagccacagcagaagcgctgggcttggacaggcctgccagcgacaaacagagccctctcaacatcaatggtgctagttatctgcggctgccctgggtcaatccttacatggagggtgccacgccagccatctaccctttcctcgactcgccaaataagtattcactgaacatgtacaaggccttgctacctcagcagtcctacagcttggcccagccgctgtattctccagtctgcaccaatggggagcgctttctctacctgccgccacctcactacgtcggtccccacatcccatcgtccttggcatcacccatgaggctctcgacaccttcggcctccccagccatcccgcctctcgtccattgcgcagacaaaagcctcccgtggaagatgggcgtcagccctgggaatcctgttgattcccacgcctatcctcacatccagaacagtaagcagcccagggttccctctgccaaggcggtcaccagtggcctgccgggggacacagctctcctgttgcccccctcgcctcggccgtcaccccgagtccaccttcccacccagcctgctgcagacacctactcggagttccacaagcactatgccaggatctccacctctccttcagttgccctgtcaaagccatacatgacagttagcagcgagttccccgcggccaggctctccaatggcaagtatcccaaggctccggaagggggcgaaggtgcccagccagtgcccgggcatgcccggaagacagcggttcaagacagaaaagatggcagctcacctcctctgttggagaagcagaccgttaccaaagacgtcacagataagccactagacttgtcttctaaagtggtggatgtagatgcttccaaagctgaccacatgaaaaagatggctcccacggtcctggttcacagcagggctggaagtggcttagtgctctccggaagtgagattccgaaagaaacactatctcctccaggaaatggttgtgctatctatagatctgaaatcatcagcactgctccctcatcctgggtggtgcccgggccaagtcctaacgaagagaacaatggcaaaagcatgtcgctgaaaaacaaggcattggactgggcgataccacagcagcggagttcatcatgcccgcgcatgggcggcaccgatgctgtcatcactaacgtttcagggtcagtgtcgagtgcaggccgcccagcctccgcatcacccgcccccaatgccaatgcagatggcaccaaaaccagcaggagctctgtagaaaccacaccatccgttattcagcacgtgggccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcagatggaaggattacaagaggacagtattttatgtctacccgctgcttactgtgagcgtgcaatgatgcgcttctcagagttggagatgaaagaaagagaaggtggccacccagcaaccaaagactccgagatgtgcaaattcagcccagccgactgggaaaggttgaaaggaaatcaggacaaaaagccaaagtcggtcaccctggaggaggccattgcagaacagaacgaaagtgagagatgcgagtatagtgttggaaacaagcaccgtgatccctttgaagccccagaggacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagc

SEQ ID NO: 111319 - DNA, 2189 bp, Homo sapiens
  Payload ID: 1798
  Gene Symbol: BCOR
  Gene Name: BCL6 corepressor
  ENST ID: ENST00000442018
  CDS Start-End: 1-999
cagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggtgagcatggctgtcatgtgattgaaaactagctgagctgctcttgaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaaggag

SEQ ID NO: 111320 - DNA, 288 bp, Homo sapiens
  Payload ID: 1798
  Gene Symbol: BCOR
  Gene Name: BCL6 corepressor
  ENST ID: ENST00000412952
  CDS Start-End: 203-288
tccattcatgcactgaagcgcgtgcagagctgctgatcgctgccattgttactcgcgggcggtgtgggagctgagcctccactctggcgagagataaatggcctctgacagcccctcctcgccaagagagctcctcggatttcaccgcgcggcggctctcagactagacgcttgaagcaaagctgccatcccagaagacgacatgctctcagcaacccccctgtatgggaacgttcacagctggatgaacagcgagagggtccgcatgtgtggggcgagcgaagacag

SEQ ID NO: 111321 - DNA, 1969 bp, Homo sapiens
  Payload ID: 1798
  Gene Symbol: BCOR
  Gene Name: BCL6 corepressor
  ENST ID: ENST00000427012
  CDS Start-End: 1-869
aggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacaggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagtaaggagctgttagatctggtggaattcacgaacgaaattcagactctgctgggctcctctgtagagtggctccaccccagtgatctggcctcagacaactactggtgagcaagctggacccaccatgtacagtgtgttatagtgttaatccttgtgcatatgtgtcataatacaactatttctgtaaagaaaggacactattacatatgaaaatatctcttctttatataagagaaattactccagtcagaaggacttagaaacatgtttttttccttttaaacttttaagtcagtttttatgaagttgttataatgtttctttacttttcaatgcacacatgctttgggatacgtttgtttttacttggaacatttgtttcttttcttttttaaggagaaaaaaaaatgagtaaaaggagctccacactttgacttaatttcatacaaagctctgatgacaggccatgactgtagagtggtcagaactgtgtggttggtttgagggagcgaattcggggaaggcacttggtgatataactttgttttgtttacagagtacctgctcgggccaggtaaatgctattggatgtaatccagtagtgtgtaatataaattcaaaccatatccacacacaacaactaattgtatgaaacttttatatcctaatttaaaagctgtgaaattagttttcacgcatcaaaccggattgtttatatgtttaaacattttatgctcttatttaaagaagactttgagctatttttttctgtaccctgtaaaatattgaaaactaacataatatgttgaggttgcttggaaatgtacataaaactaaaattttctgaatcgtgtgtttatgtttgaaatctgtgttttaactttgtaagtaaattctctgcctttgtatttatattttacaaaaattttcttaaaaggcaataaaactgttgaggaaagg

SEQ ID NO: 111322 - DNA, 1945 bp, Homo sapiens
  Payload ID: 1798
  Gene Symbol: BCOR
  Gene Name: BCL6 corepressor
  ENST ID: ENST00000413905
  CDS Start-End: 1-1785
gacaaagatcttcctgtggagaagtactttgtggagaggcagcctgtgagcgagcctcccgcagaccaggtggcctcggacatgcctcacagccccaccctccgggtggacaggaaacgcaaagtctcaggtgacagcagccacactgagaccactgcggaggaggtgccagaggaccctctgctgaaagccaaacgccgacgagtctctaaagggctccatcctaaaaaacaacgccacttgctgcaccttagagaacgatgggagcagcaggtgtcggcagcagatggcaaacctggccggcaaagcaggaaggaagtgacccaggccactcagcctgaggccattcctcaggggactaacatcactgaagagaaacctggcaggaaaagggcagaggccaaaggcaacagaagctggtcggaagagtctcttaaacccagtgacaatgaacaaggcttgcctgtgttctccggctctccgcccatgaagagtctttcatccaccagtgcaggcggcaaaaagcaggctcagccaagctgcgcaccagcctccaggccgcctgccaaacagcagaaaattaaagaaaaccagaagacagatgtgctgtgtgcagacgaagaagaggattgccaggctgcctccctgctgcagaaatacaccgacaacagcgagaagccatccgggaagagactgtgcaaaaccaaacacttgatccctcaggagtccaggcggggattgccactgacaggggaatactacgtggagaatgccgatggcaaggtgactgtccggagattcagaaagcggccggagcccagttcggactatgatctgtcaccagccaagcaggagccaaagcccttcgaccgcttgcagcaactgctaccagcctcccagtccacacagctgccatgctcaagttcccctcaggagaccacccagtctcgccctatgccgccggaagcacggagacttattgtcaataagaacgctggcgagacccttctgcagcgggcagccaggcttggctatgaggaagtggtcctgtactgcttagagaacaagatttgtgatgtaaatcatcgggacaacgcaggttactgcgccctgcatgaagcttgtgctaggggctggctcaacattgtgcgacacctccttgaatatggcgctgatgtcaactgtagtgcccaggatggaaccaggcctctgcacgatgctgttgagaacgatcacttggaaattgtccgactacttctctcttatggtgctgaccccaccttggctacgtactcaggtagaaccatcatgaaaatgacccacagtgaacttatggaaaagttcttaacagattatttaaatgacctccagggtcgcaatgatgatgacgccagtggcacttgggacttctatggcagctctgtttgtgaaccagatgatgaaagtggctatgatgttttagccaaccccccaggaccagaagaccaggatgatgatgacgatgcctatagcgatgtgtttgaatttgaattttcagagacccccctcttaccgtgttataacatccaagtatctgtggctcaggggccacgaaactggctactgctttcggatgtccttaagaaattgaaaatgtcctcccgcatatttcgctgcaattttccaaacgtggaaattgtcaccattgcagaggcagaattttatcggcaggtttctgcaagtctcttgttctcttgctccaaagacctggaagccttcaaccctgaaagaagtcccctcaaatagctagggggagtgttgaagggaaaaaaacagacgacaagaccagtaaaacagacctgtagaaatgatttaagcagaagaggactggtgaagctgaactaccatcaaagctacgagagatcctacacacccagatttaaaaaataataaaaacttaagggca

SEQ ID NO: 111323 - DNA, 2618 bp, Homo sapiens
  Payload ID: 1798
  Gene Symbol: BCOR
  Gene Name: BCL6 corepressor
  ENST ID: ENST00000615339
  CDS Start-End: 996-2231
aagcaaagctgccatcccagaagacgacatgctctcagcaacccccctgtatgggaacgttcacagctggatgaacagcgagagggtccgcatgtgtggggcgagcgaagacaggtgaatgcgcccatctgggccgggcctgagtggagcccacgcccatgctgaagcccccctcaacttctcacagccaccgtgggcccaaaaggggtgggagagaaagagcttcccgcctagtaggccgctcttgatttacagttttaacaggcaacctggctcagtgaagcattgccgccctttaaaagattagcccctaaagcggcctttcagtgcactttcgtccttaatttattatttcatatttatgaaggagaattaatcccagtctatatactgctttaactctaaatgtcaggagtgtgggcccaggtggagcagcattctatgtgcttttaaaacaaatagtttgctcagtaataaatggggagagagccaccgttttccttcattgaagcccaggatctctcattgtcctctgctgcctgttcccagaggccactggcgcctgcttttggtcgtcagacagctctgttatgcttcctaatcagtaattttggagttgtggggtggaggcagctaagcagtagatgattgaagctgctcttcggggtaatgaggaaacttttcctctgccgcttgtcagcgatttttatcctggggatttggaagttggcaccaagcactttctttatcgatgctctctgataacaagtcccagggcagccgcagcagcctggcacagatgtgcagcttccttttcagcctggaacagctgacatttgtatgatactagtgtgtatccccctgtcattttgacaaaggcagtcaaatatggcttttttatcaccatggaaaccagtttcgtaggacatggtccctaactttgttttggaaaaagttttgaaagcctaccctcctgggtaacacggaagtggttgatgacacgaccagccttccagcccccggccactcctgccaagcacagtagcagcaccagcagcaagggcgccaaagccagcaacccagaaccgagtttcaaagcaaacgagaacggccttccaccaagctctatatttctgtctccaaatgaggcattcaggtccccaccaattccctaccccaggagttacctcccttacccagcccctgagggcattgctgtaagtcccctctccttacatggcaaaggacctgtctaccctcacccagttttgttacccaatggcagtctgtttcctgggcaccttgccccaaagcctgggctgccctatgggcttcccaccggccgtccagagtttgtgacctaccaagatgccctggggttgggcatggtgcatcccatgttgataccacacacgcccatagagattactaaagaggagaaaccagagaggagatcccggtcccatgagagagcccgttacgaggacccaaccctccggaatcggttttccgagattttggaaactagcagcaccaagttacatccagatgtccccaccgacaagaacctaaagccgaaccccaactggaatcaagggaagactgttgtcaaaagcgacaagcttgtctacgtagaccttctccgagaagaaccagatgctaaaactgacacaaacgtgtccaaacccagctttgcagcagagagtgttggccagagcgctgagccccccaagccctcagttgagccggccctgcagcagcaccgtgatttcatcgccctgagagaggagttggggcgcatcagtgacttccacgaaacttatactttcaaacagccagtcttcaccgtaagcaaggacagtgttctggcaggtaccaacaaagagaacctagggttgccagtctcgactccattcctggagccacctctggggagcgatggccctgctgtaacttttggtaaaacccaagaggatcccaaaccattttgtgtgggcagtgccccaccaagtgtggatgtgacccccacctataccaaagatggagctgatgaggctgaatcaaatgatggcaaagttctgaaaccgaagccatctaagctggcaaagagaatcgccaactcagcgggttacgtgggtgaccgattcaaatgtgtcactaccgaactgtatgcagattccagtcagctcagccgggagcaacgggcattgcaggtgagcccccccacctgaatttcagttactttaccagttgtcagttttttaatgtgtaaacaggattgggggagtatggtagggcagggcaccaggcagatttggtgaatgaagcttgtggtaatttgaatatatgcaatgtggccagtaagagaacgtgagtggtagcactgaggcgtgtctggatgctttaagttattctgtagattataagggaactccactcaattgctgataaccgatgttttaattattgtgaagggtatctaaagactgcatgacgtttacctatcaattgctttgatttctctgcctgtaagatagcaaatatacctagaagtgctgcttagaatgccttacttgatacctggtagagatgtgtagcagccgcatgtctgtgggatt

SEQ ID NO: 111324 - DNA, 6860 bp, Homo sapiens
  Payload ID: 1799
  Gene Symbol: BCORL1
  Gene Name: BCL6 corepressor-like 1
  Uniprot ID: Q5H9F3
  ENST ID: ENST00000218147
  CDS Start-End: 198-5333
acacacacacaccgctctccccctcactctttcgctcgccgcggctgctgccagtgtgtggctctgtctctcctccgctttgctgagccctcccttcttcctctcagttcctagagtccgaccgccgccgccgccgagagagaggagaaggagggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaa

SEQ ID NO: 111325 - DNA, 5648 bp, Homo sapiens
  Payload ID: 1799
  Gene Symbol: BCORL1
  Gene Name: BCL6 corepressor-like 1
  ENST ID: ENST00000456822
  CDS Start-End: 1-4158
acgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaagggcaaaggtcgttggagccagcagaagacacgatctcccaaatctcccaccccagtgaaacccacagaaccatgtacaccctctaagtcccgaagtgccagctcagaggaggcctcagagtcacctacagcccggcagatccccccagaggcacgtcggctcatagtgaacaaaaatgctggtgagaccctcctgcagagggcggcgcgtcttggctataaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatgg

SEQ ID NO: 111326 - DNA, 2221 bp, Homo sapiens
  Payload ID: 1799
  Gene Symbol: BCORL1
  Gene Name: BCL6 corepressor-like 1
  ENST ID: ENST00000441294
  CDS Start-End: 1-2221
gcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctgatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaag

SEQ ID NO: 111327 - DNA, 7127 bp, Homo sapiens
  Payload ID: 1799
  Gene Symbol: BCORL1
  Gene Name: BCL6 corepressor-like 1
  Uniprot ID: Q5H9F3
  ENST ID: ENST00000540052
  CDS Start-End: 45-5180
ggggagtggccacagcaggtcctatctggtggtgagtggctgtcatgatctctacagcaccgctctacagcggcgtgcacaactggaccagttctgaccggattcgcatgtgtggcatcaacgaggagagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagcagggccgactgctcctggactccactcaacacccaaatgagcaaacaggttgactgctcacccgccggagtaaaggctttggactctcggcaaggtgttggagagaagaatactttcattttggcaactctgggaactggagtccctgtggaggggaccctgcccctggttaccactaacttcagtcctctgccagcccctatctgtccccctgctcccggttcggcctctgtgccccactctgttccagatgcattccaggttcccctctccgtccctgccccagtcccccattcagggcttgttccagtccaagttgccacttcggttccagctccttcccctcccttagcacctgtcccggctctggctccagcgccaccgtcagtgcccacgctcatctctgactcgaaccccctttctgtttcggcctcagtcttggtgcctgtgccagcttctgctcccccttcaggcccggttcccttgtcggctccagctcctgccccgctttcagtcccagtttcagctcctcccttggctctcatccaggctcctgtgcccccttcagctccgaccttggttctcgctcccgtccccactccggttctggctcccatgccagcatccacgcctccagcggcccctgcccctccgtctgtgcccatgcccactccaaccccatcttccggcccaccttctacccccaccctcatccccgcctttgctcctacaccggtgcctgcacccaccccagcccccatctttactccagcccctacacccatgcctgctgccacgccagctgccattcccacctctgcacccatcccggcctccttcagtttgagtagagtgtgctttcctgcagctcaggcaccagctatgcaaaaagtccccctgtcctttcagccagggacagtgctgaccccgagccagccgctggtatatatcccgcctccaagctgtgggcagccactcagtgtggccacactgccaaccactctaggggtttcctccactcttacgctccctgtcctgccgtcctacctgcaggacaggtgtctcccaggcgtgctagcctcccccgagctccgttcttacccgtatgcattttctgtggcccggcctctgacttcggattccaagctggtatctctggaggtgaacaggctcccctgcacttccccatccggtagcaccaccacccagcctgcacccgatggggtccctgggcctttggcagatacctcccttgttactgcttctgccaaggtgcttccaactccacagcctctgctgccagcccccagtgggagctcagccccaccgcaccccgccaagatgcccagtggcaccgagcagcaaacagaagggacttccgttaccttctctcctcttaagtcaccgccacagctggaacgagagatggcctctccacctgagtgcagcgagatgccccttgatctgtcctccaagtccaaccgccagaagcttccattgccgaaccagcgcaagacaccccccatgcctgtgttgacccccgtgcacaccagcagcaaggccctcctctccacagtcctgtctaggtctcagcgcacaacccaggctgccggtggcaatgtcacctcctgcctgggctccacttcctcgccctttgtcatctttcccgagatcgtgaggaatggggacccgagcacctgggtgaagaactcaactgcactgatcagcaccattcctggcacctacgtgggagtggccaacccagtgcctgcatccctgctgctgaacaaagaccccaacctgggcctcaaccgtgacccccgccatctccccaagcaggagcccatctccatcattgatcaaggagagcctaagggcactggtgccacgtgtggcaaaaagggcagccaggctggtgctgagggacagccaagcacagtgaaacgatatactccagcccgcattgcccctgggctgccagggtgccaaaccaaggaactctctttgtggaaacccacggggccggcaaatatttatccccggtgttcagtcaatgggaaacctaccagcacccaggtcctgcctgttggctggtccccgtaccaccaggcgtctctgctttccattggcatttccagtgccgggcagctgacccccagtcagggggcgcccatcaggcccaccagcgttgtttcggagttttctggtgtgccatctctcagctccagcgaagccgtgcacggacttcctgaggggcaaccacggcctgggggctccttcgttccagagcaggaccctgttacaaagaacaaaacttgccggattgctgccaagccttatgaagaacaagtcaatcctgtcctcttgaccctcagccctcagactgggaccctggcactgtctgttcagcctagcggtggggacattcgaatgaatcaggggcctgaggaatcagagagccacctctgctctgacagcactcctaagatggaaggcccccagggggcttgtggcctgaagctggcaggagacacgaagcctaagaaccaagtgctggccacctacatgtcccatgagctggtcctggccaccccccagaacctgcctaagatgcctgagctgcctttgctacctcacgacagccaccccaaggaacttatattggacgtggttccgagcagcaggaggggctccagcacagagcgcccacagcttggaagccaggtggatctggggcgagtgaaaatggagaaggtggatggtgatgtggtcttcaatttagccacctgcttccgggctgatggcctcccagtggctccccagaggggccaagctgaagttcgggctaaggccgggcaggctcgagtgaaacaggaaagcgtaggggtctttgcttgcaagaacaagtggcagccagatgatgtgacggaatctctgccgcccaagaagatgaagtgcggcaaagagaaggacagtgaagagcagcagctccagccacaagccaaggccgtggtccggagttcccacagacccaagtgccggaagctgcccagtgacccccaggaatccaccaagaaaagccccaggggggcttcagattcaggaaaagagcacaatggagtcaggggaaagcacaagcaccggaagccgacaaagccggagtcccagtctccaggaaaacgagccgacagccacgaggaaggttccttggaaaagaaagcaaagagcagtttccgtgactttattcctgtggttctgagcacccgcacgcgcagtcagtctggaagcatctgtagctcctttgctggcatggcagacagtgacatgggaagccaggaagtcttccccacagaagaagaagaggaggtaacccccaccccagctaagcgtcgaaaggtgagaaagacccaacgggacacccagtatcgcagccaccatgcccaggacaagtctctgctgagccagggccgaaggcacctgtggcgagcccgagaaatgccctggaggacagaggctgcccggcaaatgtgggacaccaatgaggaggaggaggaagaagaggaggagggcctgctgaagaggaagaaacgaagacggcagaagagccgaaaatatcagactggggagtacctgacagagcaagaagacgagcagcggcggaaagggagagcagatttaaaggcccgtaagcagaagacttcctcctcccaaagtttggagcaccgcctcaggaacaggaaccttctcttgcccaacaaagtccaggggatctcggattcaccaaacggtttcctcccaaataacctggaagagccagcctgccttgaaaattcagaaaagccatcaggaaaacgaaagtgcaagaccaagcacatggcaaccgtctcagaagaggcaaaggatgttgttctctactgcctccagaaagacagtgaagatgtgaatcaccgtgacaatgctggctacacagccctgcatgaggcttgttcccggggctggaccgacatcctgaacatcctgctggagcacggggccaacgtgaactgcagtgcgcaggacggcacgaggccagttcatgatgcggtggtcaatgacaacctggagaccatctggctcctgctgtcctatggggccgatcccacactggctacctactcgggtcagacagccatgaagctggccagcagcgacaccatgaagcgctttctcagtgatcacctctcggatcttcagggccgggcagagggtgatcccggtgtatcctgggatttttacagcagttctgtgttggaggaaaaagacgggtttgcctgtgacctcctacataatcctcctgggagctcagatcaagaaggagacgatccgatggaggaggatgatttcatgtttgaactctcagacaagcctcttctcccttgctacaacctccaagtgtcagtgtcccgcgggccctgcaactggttcctcttttccgatgtcttgaagaggctgaagctttcctcgaggatctttcaggcccggttcccgcactttgaaatcaccaccatgcccaaggccgagttctacaggcaggtggcctccagtcagctgctgacccctgccgagaggcctggaggcttggacgacagatcccccccaggctcctctgagactgtggagctggtgcggtacgagccagacctacttcggctcctagggtccgaggtggaattccagtcttgcaacagttgaccgggaaaacagcccctcctcttctttctccttccgagttcgcccttcccccacctccttgtctttccccgaccgagcaccagactgcagaatgaggcaataatacggaccaacaagaagccgccttatcaatgccagcattagcgactggactgtttttgtttttttggttacaattagttctcatctccctgtcgtcgtcattgttatcgtggttgctgatgggggtggaaagttgaactccatgtctgaggacaagaggtcccgggggtggtgggaggtggcgccggggtcccttggactggcctccttgttcatgaccaagaccaaacctgggccctggatggccttggcctgtcccgaggagaaatgagaaaatcccagatctctgagcgccccccaactccattcccctgtgttcttctgtcttctgtagtatttattttattagtatttaatttgtattgtttcattggtttctgataagtctgtatcactgtgacgatttgagacaacttgttgtattgagggactttctgtacctccttttctttttctttgttgatgagctctgacaaagctattccctggtgtttttttcccccactggggagggggtgaggtggaatggggtgggggaacatggacttgtgactaacgaagctggttgctgctggcccagggctgggggcttgggggtaaatcctgaggctttggtgctcccccacccacccattcccgccctttgcagcagccccgctatcttgagattagtgttgacagggaggggaggattgtgaggtgaggggttaataagttactctaataaaggagcgtggagaagggatctgaggggtgagggtggcccccctcctcacgccttcttcactgcccccctcagagtgcacaatacgagtttgttcctgcctccactctcccaccccgttctggcctccctgtctcaagatactgagcctctcacctcccagccctcagccacccccatccctgccccttctgagactcacagcacccctttccttcctctcctcccacctcctccctcagcccctcattctccttgggaatctgcagagggctctgggactcactgccggatgtgaaatccaggcgtcagctgtttcctaggcaagggcaggaaagtggtctccagcccttgctccactcatgcctgggggcctggggctgagtggtatccctacctggcctccccctggcctctgggcctccagcgctgggtttgtcgagtgagagagagagaggagcttgggttgcttccctgtccccgccccctctgtggcattgtccctcccactcttatttttctaccaattgctatttttccgaacaatccttgtagagtatgtaccatccaaaggcaggagggcctcgccgtggccggctctggttggagatggtacagttttattgtacaggtgctaaaacaacaacaacaaaaaagaaaatggaaaaaaaaaagattaaaaaaaaaaggaaaaaaaaaaagccagtttgaggatgggacaatctgttctctagaggctcctgagccatgcgggagcattggtggttattttctttgtattgtgtttgttctttgttcctgggggggaagttctcggcccccttctgtaggactgctccccacccccaccatactgcccagttggttttgaacagttgttttccctttttaagaaaaaaaaatacatatatatatacatatatatatataaagttgaggggttttggactttaatttgttggttttgttggggttcctggtattgtgtagtttatttcatgttctgtttgcctttccttttttcgcatttgggtgtatattctggctgccctttatgtttcattttaagcaactggctgtggagtcaaaaacacttgcatactgaaaaacctgtgtcaggg

SEQ ID NO: 111328 - DNA, 857 bp, Homo sapiens
  Payload ID: 1799
  Gene Symbol: BCORL1
  Gene Name: BCL6 corepressor-like 1
  ENST ID: ENST00000488135
  CDS Start-End: 296-433
ggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctagggggtcggcgtggcgaaggacggctagccttggagggaaagtagccaccagtccaactcgggtcgcccccaccattatttcgggggagtggccacagcaggtcctatctggtggtgagtggctgtcatgatctctacagcaccgctctacagcggcgtgcacaactggaccagttctgaccggattcgcatgtgtggcatcaacgaggagagtcacttccagcagtggagccctcccacttctgccagtccaactgccttttaaagggaacaagcctttccccctcggttagccccttctggatccctgaaaagatggggagaggcccgtggtgatcccccttgccttttttgcttctcttgccccagaagagcacctctttctgatgaggagtcaacgacaggcgactgccagcactttggatctcaggagttttgtgtcagcagcagtttttccaaggtggagctcacggcagttggaagtggcagcaatgcccggggggcagacccagatggcagtgctacagaaaaacttgggcacaagtcagaagacaagcctgacgatccccagccaaaaatggactacgctgggaacgtggcagaggctgagggcctcttggtgcccctgagcagcccaggagacgggctcaagcttcccgcatctgacagcgccgaggccagcaacagca

SEQ ID NO: 111329 - DNA, 468 bp, Homo sapiens
  Payload ID: 1799
  Gene Symbol: BCORL1
  Gene Name: BCL6 corepressor-like 1
  ENST ID: ENST00000607874
  CDS Start-End: 383-468
ggggactgagtggtaagcaactccgagtgttagacggtgatcgggcggcgattccgggaaaagcgaggaaagacacagtctgcgattgtgccgcaccccccacccacctcttagcatctggattctgctctcgtagtgggggccgcggaccctccccgccacagtccttttactctccagcactcccaccgccttcccccttcttcagccatctgactctcctagggggtcggcgtggcgaaggacggctagccttggagggaaagtagccaccagtccaactcgggtcgcccccaccattatttcggtgagggggcaacgctaagaaggggatactgggggagtggccacagcaggtcctatctggtggtgagtggctgtcatgatctctacagcaccgctctacagcggcgtgcacaactggaccagttctgaccggattcgcatgtgtggcatcaacgaggagag

SEQ ID NO: 111330 - DNA, 2063 bp, Homo sapiens
  Payload ID: 1800
  Gene Symbol: BFSP1
  Gene Name: beaded filament structural protein 1, filensin
  Uniprot ID: Q12934
  ENST ID: ENST00000377868
  CDS Start-End: 272-1894
aattttccatgctggaagtggaaggaattgcttgctcatttatattctctatcctgtggaaagccttccctcccaccccttgagccagtgagtcacttcctctctgcaaacctctaaagcctcctttctttctcagcccagacctggccctctggagagggttttggagtcctgggtaggcagggtacctcaggcagcaggcagcacaccttggatgtgagctgaatggattttcaaatttcacagaaggagcctccatgctggagaaagtatgtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgca

SEQ ID NO: 111331 - DNA, 2207 bp, Homo sapiens
  Payload ID: 1800
  Gene Symbol: BFSP1
  Gene Name: beaded filament structural protein 1, filensin
  Uniprot ID: Q12934
  ENST ID: ENST00000377873
  CDS Start-End: 41-2038
gccggctcggcgccgcccgcgcgcccgcgccagagcagccatgtaccggcgcagctacgtcttccagacccgcaaggagcagtacgagcacgccgacgaggcttcgcgcgccgccgagcccgagcgcccggccgacgagggctgggctggggcaacgagcctggcggcgctgcaggggctcggcgagcgcgtggccgcccacgtccagcgggcccgcgccctcgagcagcgccatgccgggctccggaggcagctggatgccttccagcgcctgggcgagctggccgggcccgaggacgccctcgcccgccaagtcgagagcaaccgccagcgcgtccgggacctggaggccgagcgcgcccggctggagcgccagggcaccgaggcgcagcgcgcgctcgacgagttccgaagcaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgca

SEQ ID NO: 111332 - DNA, 2183 bp, Homo sapiens
  Payload ID: 1800
  Gene Symbol: BFSP1
  Gene Name: beaded filament structural protein 1, filensin
  Uniprot ID: Q12934
  ENST ID: ENST00000536626
  CDS Start-End: 435-2015
gaggcgaccgtggccatgcagagtgctctgtgagtcaccgttaatttcagatggggtaaggtgaagagacgttccttgggagcccagaggagtacaggatctgatcccaagccctttaccaacaggccgcatgacacagcacttgtgagtgaggctgaacaagagaaatgagatttgaggatgtttcctgaggtcctactgtgtgccagctgcggccatgttagctaccaggaatatgaagatgaataaggagatcacaagtgaaaacagaaatgccaagataaacttggcccaagttcccttgggaattctcaggatcctacctggtgcagcagatcacaccagggagatgttactggatctttgatgagtggagcatccacagaggaaggaagtatgaaaatgagtgcgaatgtcaactcctgctaaaagaaatgcttgaacggcttaacaaggaagctgatgaagccttgctgcataacctacgccttcagctggaagcccaatttctgcaagatgatatcagtgcggcaaaggacaggcacaagaagaatcttctggaagttcagacctatatcagcatcctgcagcagatcatccacaccactcctccagcatccattgtgacgagtgggatgagggaggagaagctcctgacggagcgggaggtggccgccctgcggagtcagctggaggagggccgggaggtgctctcccacctgcaggcgcagagagtggagctgcaggcacagacaacaactctggaacaagctattaaaagtgcccatgagtgttatgacgatgagattcagctttataacgagcagattgagacactgcgcaaggagattgaggagacagagcgggtcctggagaagtcttcttacgactgccggcagctggcggtcgcccagcaaaccctgaagaatgagctggaccggtatcatcgtatcatcgagattgaaggcaacaggctgacctctgccttcattgaaactcccattcccctgttcacccagagccatggagtctctctcagcactggatccggtgggaaagatcttaccagagctctgcaggatataacagcagcaaaaccaagacaaaaagccctccccaagaatgttccaaggagaaaagagattataacaaaagacaaaaccaacggagctctggaagatgcaccattaaaaggtttggaagacacaaagctggtacaggtggtacttaaagaggaaagtgaatctaagtttgaatcagaaagtaaagaagtaagtcccctgacacaagaaggggctccagaggatgtgccagatggagggcagataagcaaaggctttgggaaactatacaggaaggtcaaggagaaagtgagaagccccaaagagcctgagacccccactgagctctacaccaaagagcggcacgtgctggtcacaggggatgccaattacgtggaccctagattctatgtctcctccatcacagctaaaggtggggtggctgtttctgttgcggaagactctgtgctttatgacggccaggtggagccctctcctgagtcacccaagccccctttagagaatgggcaggtgggtctgcaggagaaagaagatggacaaccaattgaccagcagcctatagacaaggagattgagccagatggtgcagagctggaaggccctgaagagaaacgtgagggtgaggagcgggacgaagagtccaggagaccctgtgccatggtcacacccggtgcagaggaaccatctatacctgagcctccaaagcctgcggctgatcaggatggagctgaggtgcttgggactaggagcagaagcctgccagaaaaaggccctcccaaggctttggcctataagacagtggaagtggtggaatctatcgagaagatttccacggagagcattcagacatatgaagaaaccgctgtgatcgtggagaccatgattggaaagacaaagtcagacaagaagaaatcaggagagaagagctcttaaaatgcccaggcttgatgggataaaatgtatttggggccactgtaggggtaatgctttgatattttagagcaaatgataaaagggtgagggttcctgtttggattagaccatagttgacccatctggcattgccaacgaagccttcattaaaatgttttctttgcttgc

SEQ ID NO: 111333 - DNA, 1558 bp, Homo sapiens
  Payload ID: 1801
  Gene Symbol: BFSP2
  Gene Name: beaded filament structural protein 2, phakinin
  Uniprot ID: Q13515
  ENST ID: ENST00000302334
  CDS Start-End: 90-1337
cgtgaccaggccacagggatgctggggctgtaaaccaaaagccactggactctgtaaacccactgggcaccacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcggcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgctt

SEQ ID NO: 111334 - DNA, 2112 bp, Homo sapiens
  Payload ID: 1802
  Gene Symbol: BECN1
  Gene Name: beclin 1, autophagy related
  Uniprot ID: Q14457
  ENST ID: ENST00000361523
  CDS Start-End: 134-1486
gctgaagacagagcgatggtagttctggaggcctcgctccggggccgacccgaggccacagtgcctccgcggtagaccggacttgggtgacgggctccgggctcccgaggtgaagagcatcgggggctgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactg

SEQ ID NO: 111335 - DNA, 1569 bp, Homo sapiens
  Payload ID: 1802
  Gene Symbol: BECN1
  Gene Name: beclin 1, autophagy related
  ENST ID: ENST00000438274
  CDS Start-End: 136-975
ttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacct

SEQ ID NO: 111336 - DNA, 2087 bp, Homo sapiens
  Payload ID: 1802
  Gene Symbol: BECN1
  Gene Name: beclin 1, autophagy related
  Uniprot ID: Q14457
  ENST ID: ENST00000590099
  CDS Start-End: 112-1464
gctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaa

SEQ ID NO: 111337 - DNA, 559 bp, Homo sapiens
  Payload ID: 1802
  Gene Symbol: BECN1
  Gene Name: beclin 1, autophagy related
  ENST ID: ENST00000591085
  CDS Start-End: 136-366
ttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacaggtcagcgagacccttggaaagagggtggtcaagaatgtggaagctccattacttaccacagcccaggcgaaaccaggagagacccaggaggaagagactaactcaggagaggagccatttattgaaactcctcgccaggatggtgtctctcgcagattcatccccccagccaggatgatgtccacagaaagtgccaacagcttcactctgattggggaggcatctgatggcggcaccatggagaacctcagccgaagactgaaggtcactggggacctttttgacatcatgtcg

SEQ ID NO: 111338 - DNA, 524 bp, Homo sapiens
  Payload ID: 1802
  Gene Symbol: BECN1
  Gene Name: beclin 1, autophagy related
  ENST ID: ENST00000587880
  CDS Start-End: 1-168
ggaaaccattcatatctggagtctctgacagacaaatctaaggctgaagtgcaatggcatgatctcggcttactgcaacctccgcctcccgggttcaagcaattcccctgcctcagcctcctgagtatctgggattacaggcatgcaccaccacgcccggctaattaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaatttt

SEQ ID NO: 111339 - DNA, 731 bp, Homo sapiens
  Payload ID: 1802
  Gene Symbol: BECN1
  Gene Name: beclin 1, autophagy related
  ENST ID: ENST00000586589
  CDS Start-End: 1-689
cgggccagacagatgtggatcacccactctgtgaggaatgcacagatactcttttagaccagctggacactcagctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagtatcagagagaatacagtgaatttaaacgacagcagctggagctggatgatgagctgaagagtgttgaaaaccagatgcgttatgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagagataccgacttgttccttacggaaaccattcatatctggagtctctgacagacaaatctaaggatggatgtggagaaaggcaagattgaagacacaggaggcagtggcggctcctattccatcaaaaccca

SEQ ID NO: 111340 - DNA, 769 bp, Homo sapiens
  Payload ID: 1802
  Gene Symbol: BECN1
  Gene Name: beclin 1, autophagy related
  ENST ID: ENST00000588276
  CDS Start-End: 1-319
gcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttac

SEQ ID NO: 111341 - DNA, 629 bp, Homo sapiens
  Payload ID: 1802
  Gene Symbol: BECN1
  Gene Name: beclin 1, autophagy related
  ENST ID: ENST00000593205
  CDS Start-End: 100-629
gcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggaggaagagactaactcaggagaggagccatttattgaaactcctcgccaggatggtgtctctcgcagattcatccccccagccagacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagcacagtggacagtttggcacaatcaataacttcaggctgggtcgcctgcccagtgttcccgtggaatggaatga

SEQ ID NO: 111342 - DNA, 561 bp, Homo sapiens
  Payload ID: 1802
  Gene Symbol: BECN1
  Gene Name: beclin 1, autophagy related
  ENST ID: ENST00000589636
  CDS Start-End: 384-561
gcgcagccgcgatgaggcatggctttggacgctcccagcggggttcacactgccggggtcaagtgtcgggtaggggtaaagtaaaaaggagagctgtggggaatggtgcgctgagaactgagcctccgagagactcggaaacggtgcggccctctctgttgtcccggaactcgccttcaccgaagggaccttctcagccgctgcactcccggggacaacgccgtcgcgccccaaagcccgttacttctctatgcgtttctgagatgttagggacagccaagcaggaagaaacgcaggactatgaagcagccacaccaggactaggtaccctctgtgctcttgctgttcccttggcctagaatgctcttccttaagatgcagggatggaagggtctaagacgtccaacaacagcaccatgcaggtgagcttcgtgtgccagcgctgcagccagcccctgaaactggacacgagtttcaagatcctggaccgtgtcaccatccaggaactcacagctccattacttaccacagcccaggcgaaaccaggagagacccaggagg

SEQ ID NO: 111343 - DNA, 489 bp, Homo sapiens
  Payload ID: 1802
  Gene Symbol: BECN1
  Gene Name: beclin 1, autophagy related
  ENST ID: ENST00000589663
  CDS Start-End: 1-399
ctcaacgtcactgaaaatgagtgtcagaactacaaacgctgtttggagatcttagagcaaatgaatgaggatgacagtgaacagttacagatggagctaaaggagctggcactagaggaggagaggctgatccaggagctggaagacgtggaaaagaaccgcaagatagtggcagaaaatctcgagaaggtccaggctgaggctgagagactggatcaggaggaagctcagatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaa

SEQ ID NO: 111344 - DNA, 570 bp, Homo sapiens
  Payload ID: 1802
  Gene Symbol: BECN1
  Gene Name: beclin 1, autophagy related
  ENST ID: ENST00000590852
  CDS Start-End: 1-218
atgcccagacgcagctggataagctgaagaaaaccaacgtctttaatgcaaccttccacatctggcacagtggacagtttggcacaatcaataacttcaggctgggtcgcctgcccagtgttcccgtggaatggaatgagattaatgctgcttggggccagactgtgttgctgctccatgctctggccaataagatgggtctgaaatttcagaggtaggaagtgtagccctttcttggggagtgatgtgcattgatataatttgtatctccaacctggtactgctgtccaccatgtcaggagcccttgctgcccacagactgggagttttctgtggctgaagagctgtcagcatctgattttcccctcatcacagggctctctccactgatcacacagtcactgagttgcgtgactatagcatagttcccagcctacagtccccagagccttagtgttcctcaggatattttcagtttttgtttcttaaatttaaaccaaaacataacatttgttcatggaaggcccccaggcaattatataataaatgtagtttgttcattaaacaaaa

SEQ ID NO: 111345 - DNA, 854 bp, Homo sapiens
  Payload ID: 1802
  Gene Symbol: BECN1
  Gene Name: beclin 1, autophagy related
  ENST ID: ENST00000590764
  CDS Start-End: 1-329
atgctgcttggggccagactgtgttgctgctccatgctctggccaataagatgggtctgaaatttcagaggagctgccgttatactgttctggggggttgcggtttttctgggacaacaagtttgaccatgcaatggtggctttcctggactgtgtgcagcagttcaaagaagaggttgagaaaggcgagacacgtttttgtcttccctacaggatggatgtggagaaaggcaagattgaagacacaggaggcagtggcggctcctattccatcaaaacccagtttaactctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatc

SEQ ID NO: 111346 - DNA, 559 bp, Homo sapiens
  Payload ID: 1802
  Gene Symbol: BECN1
  Gene Name: beclin 1, autophagy related
  ENST ID: ENST00000612631
  CDS Start-End: 500-559
atggctttggacgctcccagcggggttcacactgccggggtcaagtgtcgggtaggggtaaagtaaaaaggagagctgtggggaatggtgcgctgagaactgagcctccgagagactcggaaacggtgcggccctctctgttgtcccggaactcgccttcaccgaagggaccttctcagccgctgcactcccggggacaacgccgtcgcgccccagtaccctctgtgctcttgctgttcccttggcctagaatgctcttccttaagatgcagcccggcctctgggggccgctgccgggcctgtgagcctgtggaccaggagctcctgctgccgtcgtagcgtcacgtccggtctcgggcggaagttttccggcggctaccgggaagtcgctgaagacagagcgatggtagttctggaggcctcgctccggggccgacccgaggccacagtgcctccgcggtagaccggacttgggtgacgggctccgggctcccgagggatggaagggtctaagacgtccaacaacagcaccatgcaggtgagcttcgtgtgccagcgc

SEQ ID NO: 111347 - DNA, 1296 bp, Homo sapiens
  Payload ID: 1803
  Gene Symbol: BECN2
  Gene Name: beclin 2
  Uniprot ID: A8MW95
  ENST ID: ENST00000419583
  CDS Start-End: 1-1296
atgtcttccatccgcttcctgtgccagcgctgccaccaggccctgaagctgagcggctcctcggagtctaggagcctccctgcagccccggcgcccacctctgggcaggctgagcccggagacacccgggagcccggcgtcaccaccagggaggtgacagacgctgaggagcaacaggacggtgcctctagcagatcccctccaggcgatggcagtgtgtccaagggccatgccaacatcttcaccctgctgggggagcttggcgccatgcacatgctcagtagcatccagaaggcagctggtgacatttttgacatagtctctggccaagcagttgtggaccatcccctgtgtgaagaatgcaccgacagtcttttagagcagctggacatccagctcgctctcacagaagctgacagtcagaactaccaacgctgcctggagaccggggagctggcgaccagcgaggacgaggcggcggcgctgcgggcggagctgcgggacctggagctggaggaggccaggctggtgcaggagctggaggatgtggacaggaacaatgcaagagcagcggcggatctccaggcagcccaggcagaggctgcggagctggaccagcaggagaggcagcactacagggactacagtgccttgaagcggcagcagctggaactgcttgatcagctggggaacgtggagaaccagctgcagtatgccagggtccagagggaccggctgaaggaaatcaactgtttcaccgccacgtttgagatctgggtggagggccccttgggcgtcatcaataacttcaggttgggccgcctccccactgtccgtgtgggctggaatgagattaacactgcctggggacaggcggccttgctgctccttaccctggccaatacaattggactgcagtttcagaggtatcgactcatcccctgcggaaaccattcgtatctgaagtctttaacagatgaccgcactgagctgccgttgttctgttatggggggcaggatgttttcctcaataacaagtatgaccgcgcgatggtggccttcctggactgcatgcagcagttcaaggaagaggctgagaagggtgagctgggcctctctctgccctacgggatccaggtggagacaggcctgatggaggacgttggcggccgaggggaatgctattccatcagaacccatctgaacacgcaggagctgtggacaaaggcactcaagttcatgcttataaatttcaagtggagtctcatctgggttgcctcaaggtatcaaaagtag

SEQ ID NO: 111348 - DNA, 1938 bp, Homo sapiens
  Payload ID: 1804
  Gene Symbol: BEND2
  Gene Name: BEN domain containing 2
  Uniprot ID: Q8NDZ0
  ENST ID: ENST00000380030
  CDS Start-End: 1-1938
atgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggaatctggcccacaaatgagttatgggacaatgagttactcaactgaaatgaaaaataactgtgaccaagatgatgcttcagcatctgcctgcctcactcccgattttgcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagaatatctggcaacaacttttcccacctgtgatttgcatgaacatggaaaagactggcaggactgtatttctggtatcaattctatgatctactgtttatgttctgaaggcaagagtactccaaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgaggtttgttacacatagagtatgtctga

SEQ ID NO: 111349 - DNA, 4611 bp, Homo sapiens
  Payload ID: 1804
  Gene Symbol: BEND2
  Gene Name: BEN domain containing 2
  Uniprot ID: Q8NDZ0
  ENST ID: ENST00000380033
  CDS Start-End: 134-2533
gtgcctcggacaacgagtgtacgcagttaccacacagttaccaagcagttacctcagagccgcggcgcagacgtaggcctcaggtctcgggcctcaggtctcgggcctcagagccagaccccgccatctcacgatgtcagagaggacccaggaacaggattttgttattataactgtcgacgacagtgatgataacaatgattgcagtattgagatggtggaagtttctgaaacagcagataattccactaatgacatagcagatgattccacttatgtcacagcagataatcccactgatgacacagccacacaaccaaattttccaggcggcaatgatggccatcaccgtccactccaaatgtcatatgggtctggctctgtcacccaggctggagtgcagtggcatgatcacagctcactgcagcctcaacctcttggactcaagcaattcttccacctcagccttcccagtagctgggatgacaggcgcacgccaccatgcccagtagcccatggtgaccaaatagtttcacagataaaccacccagtacatttaagaagatacagttacaactcagaggaagtggattttccaaaaagaggaagattctatactccagaggtacagtctagcatatcaccaccagcggaaaggcaggaaacccatgcctgggccagccctgctgtaacatctcttgagtcagcagcatgtcatgaactgcaggaagcagacctcagtgagagtttatcatatcccagaattgtctcctcaagttcattacagcagtatgtcgcacaaggtggctcatttccttgtttcggtatgccatggaactttatcagtggaggtgctgaaagtaccaatgctgtcatctcatttgccaatgctactacagcagtacctatggcagttctgtcacgaagagaatccagtctggcaaataaccctggtgtggtgaattactctgctctaccagaaaatgaaaatgtgggcccaggtagagccttgtcatctttctgcttccatcccaatttggaaatgccagaaagaccagcaaacagcagtaaaaacagcactgagacagcgaattatccaactttaatgggaaattacaatggccaaaatactgcctctttatctgtcttcatccctccctattttgctgagaaaattatacttactgaaatgccaggaacaacagaaaccaacgtggaaaataactctcagacagtgtattacccagctttatcgggaaatacgagtgccccatatccagcctcttcatatcttcccatcacttctaattttgaatctggcccacaaatgagttatgggacaatgagttactcaactgaaatgaaaaataactgtgaccaagatgatgcttcagcatctgcctgcctcactcccgattttgcactgttacctctgaatattttggtaaaagtagacaccaacacggaaaacagcgtcaacacaatgaatcgctcaactttattggacagtgacagtggccaggattcttcctcatcatctgtctgtatccctcccaagtatggctatcttggtgatccaaaaagaaatgtcagagtacttaaaatccatttgctggccgtacaaaatatggccaaacctaagcaagcagcctgctacttggttcgtattttgttctccaaggaaatcctgattagcagctcagtggatatccatttgaaagacagccaatccctcgacccgaacaaaatggctgcattgagagaatatctggcaacaacttttcccacctgtgatttgcatgaacatggaaaagactggcaggactgtatttctggtatcaattctatgatctactgtttatgttctgaaggcaagagtactccaaaaactgttcgcaaaaataaaaaacgtaccaaccgtgttgcatcggcatctgcagatagaaatgaccaaaggggcagagatggtggtgaaggctgttcttggatgtttcagccaatgaataactccaaaatgagagaaaagaggaacttgcagccaaacagtaatgctatccctgaaggaatgcgagaaccttccactgataatccagaggaacctggtgaagcatggagctattttggaagaccatggagaaatatacggatgccatgttcagtactgactttggcaaaaactaagtcttgcgcaagcctgtcggctagataccttattcagaaactcttcacaaaagatgtcctggtccaaagtaacgtctatggcaatctgaagcatggcctgtgtgcccttgaccccaataagattagtgctctccgagagttcctccaagaaaactacccaatttgtgatctctcggaaaatggaagagactggaagtcgtgtgtgacctccatcaacagcggtatccgtagccttagacatgacgtcagaagggctgaagccaggtctcagtcgcttccagcagtgacccctccagagctggagcaggagtcaaagccaggagatcccgacgccactgacccaagcacctgaacggcagctgccaaactttttttttttttttaactgttaagactattttgtaagtttctcaagttctaattccaaaatcagcctgctgtactggcagagtagtttgcattgacacctgtagtaatcgccaaacctctttttctgctcataaaggaggtagaatcacattaggaagatacgtaatgtttcatctgtggatttgatgacaacctctgattgagggaatggtagtaaactcctcatgggcttgtgacccatggctttgacttagataattgacattaatatactttgtttttttgataaggtagagaaagaaattcaatagaaagtaaggagccactcagtcaaataatataattcgtataaaacttgacaagtctttttatttttgtgacttgtgagatagtttaagatatttttatgtgaccaatttgtagaatgaatacatattttcaaagttatcttttcaaaattcaacttttagagtattttagcaaaatatatgtatagtttataatatagaagtatagctttataaagatattaaggatttattttttaaaataattctctgaatagtttgctgtagtagttgccttcagcttaataaaaccatagtacttctacatacatctttataagttaggctatgcctacaaaggtcttaaaaagtagataatttaccgggtgtagtggctcacacctgtaatcccagcactttgggaggccgagacgggtggatcacctgaggtcaggggttcgagaccagcctggccaacatgacgaaaccccatctctactaaaaatacaaaaaaagtagccaggcatggtggcaagcacctgtagtcccagttactcgggtggctgaggcaggagaatcacttgaacctgggaggtggagactgcagtgagccgagattgtgccactgcactcgagcctgggtgacagagtgagactccgtctcgggaaaagaaaaaaaagaagtagataattaaaaaaatcttgcataaaaaaaaatcttccataaagggcaaaaaggctttaacttccattattcagatttaatccaactaagatagtctttggcttcattcactgttcagtttcacaagttttttacaactactagtaacagagctaatacagaatagtaatccacattataaacatagatcaaaataccacatcataccccataaatacatgcagttattatttgtcaattaaaaataaaatttttttaaaagaaaagtacagttcgaccctaggcaagaagaaatttcaaattgtatatgcatattttgaatttggtttatattttgtggtatctgaaatattccctggactagaagcaaaaccacagaaacaaaactttacatttagaaaaaaatttcaagacttctattgctaactttattacattagtggtttttagaagttatttagagcagtcttgtctgatagaactttccaccatgatggaaatgtaaataaatataccacattaaaaatataaatttgcaatgtccaataggctcgtatggctattgagcatttaagatgtaattaattagacagaggaagtaaatttaacattttctctcattttagctaattagaatttaaagtgaaatagccacaagtggatagtggctactgtgttggatggcacagttcaaaatgcctcttatttataaaaaaaagtgtttaaaagtggttcccatggcttgaagaggaataatatacacataacttctttaaaatcacattttgtttgagatggagatcttgctatattgcccaggcttatctggaactcctgggctcaagagggaggatcacatttgactggacaaaatacattttataaaggtgttttgtattttatgttaaagtggaattgtgtcttcaaaattgtgtcttcaaaatttcacaagttaatactattactgtattagtccaatgttaaacattttaaatgcctgctcataagactcatttttgataaataaatgtatctttaatgttttgtttcccaaatagatacaataaataaacatttaaaatgccttaa

SEQ ID NO: 111350 - DNA, 6200 bp, Homo sapiens
  Payload ID: 1805
  Gene Symbol: BEND3
  Gene Name: BEN domain containing 3
  Uniprot ID: Q5T5X7
  ENST ID: ENST00000369042
  CDS Start-End: 192-2678
acacaaagagaggggaaaatacacggcgctcgcccgcccgccgcccccagcgcctccccgggccgccctggccaggccctccgcgcgcggcccccactccccggccccgcgccctcccccccacgtggcgcccaaactcggcgcgggcccgcccggcaaagtacagaactcgcgtcccagcggaatagaagatgaactcaactgaattcaccgaagatgtagaagaagttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatagaaaaa

SEQ ID NO: 111351 - DNA, 6654 bp, Homo sapiens
  Payload ID: 1805
  Gene Symbol: BEND3
  Gene Name: BEN domain containing 3
  Uniprot ID: Q5T5X7
  ENST ID: ENST00000429433
  CDS Start-End: 651-3137
atgggccccgccgccagggggcgcagcgctcccttcccggccgttccacggcggttcgcggttcccgctgcccaggagctggaggcgggcccggcgccttgggtgtgcacccgggctggcgcgaggcctggccggccggccgcaaagctgaagcctggggcgctcgccgctcctcgtgagcgctcctttccttctctatgataaacgtgatttcccacgcatgctttgcccttgcctcatccgtgagctgtgcaccaccgatttggaggcccttgtgtgcttgtttacctacgtctccctatgtagctattttaaacaaggtgtttttacagagataaaagttttattgattgctcaggtggtctttctggaagaattctgcacgtaaacgctaactcgacaagagtgccgggaggaacaaggttactcactagagttggaaatgtgcagttcatctccttaaagtaacttttgaatggttgaatacaaatagtaaacatgccacagggcagcgtggcatagtgccagaaagctacggttgcaggaaactgaggtttaatttttagaagtcaatgtcacctgtagcagagaagttccttgaaatcaaatcagacatatggcaattgtgaaaagattgaacggaatagaagatgaactcaactgaattcaccgaagatgtagaagaagttctaaaaagtatcactgtgaaagtggagacagaggctgaagatgctgctctggactgctccgtgaattccaggacttctgagaagcactctgtggacagcgtcctcactgccctgcaggactccagcaaacgaaagcagctggtcagcgatggcctgctagactctgtccccggcgtgaagaggaggcggctgatccccgaggctctcctagcaggcatgcggaaccgtgagaacagctcgccctgccaaggcaatggtgagcaggccggcaggggcaggagcctgggcaatgtgtggcctggagaggaggagccctgcaacgatgccaccaccccttcctacaagaagcctctgtatggcatctcgcacaagatcatggagaagaagaatcctccctcgggggacctgctaaacgtgtacgagctctttgagaaggcaaacgccagcaacagcccctcgtcactgcggctcctgaatgagccacagaagcgggactgtggcagcaccggggcaggcactgacaacgaccccaacatctacttcctgatccagaagatgttctacatgctgaacaccctcacgtccaacatgtcccagctgcacagcaaggtggacctgctctcccttgaggtgagccgcatcaagaagcaggtgagccccactgagatggtggccaaattccagccgccccctgagtaccagctcacagccgcagagctcaagcagatcgtggaccagagcctgtcagggggggacctggcctgccgcttgctggtgcagctcttccccgagctcttcagcgacgtggacttctcccggggctgcagtgcctgtggctttgcggccaagcgcaagctggagtcgctgcacctgcagctcatccgcaactatgtggaggtctactacccctcggtgaaggacacggctgtgtggcaggccgagtgcctgccccagctgaacgacttcttcagccgcttctgggcccagcgggaaatggaggacagccagcccagcggccaggtcgccagcttctttgaggcagagcaggtggaccccggccacttcctggacaacaaagaccaggaggaggccctgtctcttgaccggagcagcaccatcgcctcagaccacgtggtggacacgcaggacctcactgagttcctggacgaagcctcctcaccaggcgagtttgccgtcttcctcctccaccggctcttccccgagctcttcgaccaccgcaagctgggtgaacagtacagctgctacggggacggtggaaagcaggagctggacccgcagcggctgcagatcatccgcaactacacggagatctacttccctgacatgcaggaggaggaggcctggctgcagcagtgtgcccagcgcatcaacgacgagctcgagggcctggggctggacgcgggcagtgaaggcgaccccccgcgtgatgactgctacgactcctccagtctgcccgacgacatctcagtggtcaaggtggaggacagcttcgagggcgagcggccgggtcgccgctccaagaagatctggctggtgcccatcgacttcgacaagttagagatcccccagcctgacttcgaggtgcccggtgccgactgcctgctcagcaaggagcagctacgcagcatctacgagagcagcctgtccatcggcaacttcgcctcgcgcctgctggtgcacctgttccccgagctcttcacgcacgagaacctgcgcaagcagtacaactgcagcggctccctgggcaagaagcagctggacccctcccgcatcaagctcatccgccactacgtgcagctgctctacccacgcgccaaaaacgaccgcgtctggaccctggagttcgtgggcaaactggatgagcgctgccggcgccgggacacggagcaaaggcgctcctaccagcagcagcgcaaggtccacgtgccgggccctgagtgcagagacttgaccagctatgcaatcaaccccgagaggttccgggaggagtttgaggggcccccactgccccccgagaggagcagcaaggacttttgcaagatccccttggacgagctggtggtcccctcgcctgacttcccggtgccttctccctacctgctgtctgacaaggaggtgcgtgagatcgtgcagcagagcctctccgtgggcaactttgccgcccggctcctcgtccgcctgtttcccgaactcttcaccgccgagaacctccggctgcagtacaaccattccggggcttgcaacaagaagcaactggaccccacgcggctgcggctcatccgccactacgtggaagccgtctacccggtggagaagatggaggaggtgtggcactacgaatgtatccccagcatcgatgagaggtgccgccgccccaacaggaaaaaatgcgacatcctcaagaaagcaaagaaagtggagaagtgaaggcccgtgacctgcccagagattcggggtcaccagaggctgagcgatgggcacccttgggactgagcaatacttgggagcacgcctatggcatccacagacaggcaccttatgtccgtggggagtggcttactacatttgcacacgtaaacacccacccaaccgcaagaaagaagccttgagtttggtctcttgtacttacaacttctgtcctatgtgccccggcggggcagcctgagtgtggggagagcaagctgtgagggcagggaccagaggttaggggtcctctctccctggttgtgccctccccagcccctcacagcttataatgcaaacccagcaactctcttgcccctcttcccatattttacatcttccattttgacccatttttttttaattaaaaagaaacccttaaaaaaaatcattgggctctttgggggccattttacttagaaaaaaatctctttaaaagtgccatgttcgtgcacagtggctaatcatagcttcaggtggcatggatactgattttactgaccttgttttttacatctgattttggaagagtcaagatgccccttggatggcagtagaggggatggaatagtgcgaagtcctttacgaccacatgcaagttttcccttctgctctggtgccagggaaggcttccgttcagcttggcctgtccttcaggcgcgttggtagaatgttgtgtcactctttaggcgagaacactggatgatgatgatatgaatgtagacagccgtggaaacacgttcgcagtgtctccatctgagccgtgtccttccgctgcccccattccttctccatacatggttgctggttggagggagtggacatgtttccttggaaaacagtgcaggggcttttggcttcttgttagatttaagggtgggcctctttgagctcaccatgaactgtttacttttccgtgtgtgtatttgtacaaaatccaggttccgggagctttgtggtgacttccccagacctcagtgttagctactccaggcagtactacatcctcattcctcagggcgggcccaggtctgggcccctcttggggataccatgcattggaaggacacaggccattttagatggggtacacatgtcccttcccagggtccactcagaactttcctcttggactctctagaaggtcctgctgtcctatacctggccaccccctgccttggggggcacatgtcttcgttccctcccgactgggaatgtcaggctcctgcaggccagctgcatgctctccaggagcaccaactgggaaatcccctgacaggtaaagtcctttaaaatgatacttttacctacctaactctgggggccaaatgcttaagagggaaaggaaacagtcgaatgcaaacagtgtgtcataccagagtcctggaaaatttattgaatcacacagggtagtcatagaacccctgtgggatggcttaatattttgctactttaaaatgcagagataacagaaacaatctggattttcttcattcagctgataagaacttcagttccagtggctgtatgacataattttgcctgtacccaggagcattttttaaaatacaggattttaaaagcaatgttaagttgctgatctaactagtaaatttgctcctaagtgtcatttacagattatttctgttgaaactgcaaacagatttagaaaggcacagggactgaatgactctctgtcttacacagctactcatgcacacacgcactgcttactaaaagctgaagtgagatgaagggggcctacacgaataacaagttcaacttctttgtgcctggaaaggagggactggagcagccaggagactcactttcccccctcgcttgggcccttctctatgccttagtctctccagcacatgcacacagcatgcacacacacgcaccctacccaaagacagctgtggccctctcccaccacctcccccttcccaccgctggttgttgggggctggaggcgggaggtcccatggaatttgttctggtttctaggatgtaaacgaggactccaagccatgaattgccctgctttctagagggtggaatgttgaccctgcaactttagaagcacaatcatttattaataatttttttgaaactcccatctacccctgttagagaaatcaacaggttctaggaattaaatatgtctctttgtaacccagagcatgttcaatttttggaaaccgtatttcagtgattttcttaataccttacatgtgtagggcatcttcccccagaatcttacagtccctttctgtgaagagaagtggacacacgtgggaactctcaccatctctggactgtcgtcaggaaacgcctgcaggtccttgccctgtctgtatggtgtcctcacttctccatccatacaggtggctccagtgggcatttttttattttaaattttttacatgaagcaatagaagtacaaaatacttattttttcaaaatttaatgtgttccatgaaacctgttggcagtcgctttccttcccccacatctaaattctttggtttttagttgtttgttttttggatttttttttttttttttttggccttgtatcccaaggactaaaagattagcacagacacgttttgatgttgaatgaactagtaagtcacagtaggtggtagtcttcattgatttctctgtaagtttttaaagaatgtatgaagatagtcacgaatgtactgagtgttcgcatcccccttcagttcaccttggctgtgtctacaggacaacaaatgtttgacagggaataaagtcgtgtctggtgtcatttgcgctagcgtgcccctcccctttcggtgttggctccaaaccttcctttccttttatgtttgtggggagtggggaaccacatcagcagcaatcatcaaccaaccaaccaatgggatctacttagtggtgaatagattggctatttaattggtaaaagttgctggtctgaccacaccacagcatgaccactgggttcatttagagatggcctccgtttccaacgttccccacaaatgtttgcttctttcccagtcaagaggggatctcgagactcccgagtggaggtcgtgagcttgcaccccgcctggctgtgtagatcgactgtatagatacatgaagtgggggtgagggccaaggggctattactgctgttgggaaatacttgcctctcgtagatccagccttaatgtttttctgacatcctagtaatagcagaccctgcacaaagtggatatcagacttaatactgtgaggagacaaaataatgagaatagttttaccaaagataatgaaatctcgcatcatgtctgcattttaccatagattggagtgcatccttaggaaactgaatgtaacaaaaacccaggacatttttggaaattgtatgctctctagcaactttgtgtgaatttttatacaaacactgttttatgagttatataaaatgttataaaaatag

SEQ ID NO: 111352 - DNA, 8692 bp, Homo sapiens
  Payload ID: 1806
  Gene Symbol: BEND4
  Gene Name: BEN domain containing 4
  ENST ID: ENST00000504360
  CDS Start-End: 593-1906
gcgatgctcggggaaagcaggaccccaaagccccgtaaacaccgcgcgaccacccgggccaagatcttcaagaggttcttttcagaaggatcggagagcaattcccgattggtagaagaacttgctgtaatacacacgtactctgacgaccccgccccaacgactagcccctcctctgtgcaaccccgagagtttggggtcatgcagggggcgccacgagctcgtttcggaagccggaccccgcccgcagccgcagaagcctcgagtccacatctgggtctctaaagtctcgccgtagccagatcccggatccccaccttcttcaccagttcccgggcgtcctccaggcattggcgaggcagcctgtcaatcaggagctcgggcggcagccccccgcgcgggggctcggcgatgccagcctcagcgacaggcggcggcggcggcggccacggcacagacacacaccctcccacacgcgcgcaccagggcagacccggcgggcaggcggcggaggcaccctcggagcccggcgcccggcggggaggggacgtgctccgagggaccggccccgaggcgccggatggaggaagagatgcagccggcagaggaggggcccagcgtccccaaaatctacaagcagcgcagcccctacagcgtcctcaagacgttccccagcaagagaccggcgctggccaagcgctacgagcgacccaccctggtggagctgccgcacgtgcgggcgcccccgccgcccccgccgcccttcgcgccgcacgccgccgtctccatcagcagcagcgagccgccgccgcagcagttccaggcgcagagctcctacccccccgggcccggccgggccgccgccgccgcttcgtcgtcgtcgccgtcctgcacgcccgccacatcccagggccacttgaggactccggcgcagccgccgcccgcgtcccccgccgcctcctcgtcgtcttcgttcgccgctgtcgtcaggtatggcccaggcgcggcggcggccgccggcaccggcggcacgggtagcgacagcgccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagcctcatctgtttttccatcttaccttaatttttcattggccttaagttgtccttactgctgaatacatcgttctgtttttctaaagcaacaatatttgatcactgcttttaagaaaaacagactagcccttcttgtttttctggaagtttgagagtcctgaatatttcttcatatccaaatatcatcttggagccctatcgtgctggtcttcgctgaggctgatgagagcactttctgcacccctgctccatggccgtacatgacaacgcacctgcaccactgctgcaagggcggggggcagcagcctgtgttttggctgtcactgttacctcctgagaaggctgctgtcccaggtttgcacaccacttttgttccaaagttacacatggtctcttcctccctcgcacccattccaggttaatcatttctctatcagctgtttctccatccacagattctgaatgttgagactaattgttgggcatctcttttgcacaaggctgacagactccatactcagcatcgcacagccagttctaactcctctgctgggtctcggacctacagcttttgcctgagtgaaatgttcctacgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgtt

SEQ ID NO: 111353 - DNA, 8765 bp, Homo sapiens
  Payload ID: 1806
  Gene Symbol: BEND4
  Gene Name: BEN domain containing 4
  Uniprot ID: Q6ZU67
  ENST ID: ENST00000502486
  CDS Start-End: 581-2185
gcgatgctcggggaaagcaggaccccaaagccccgtaaacaccgcgcgaccacccgggccaagatcttcaagaggttcttttcagaaggatcggagagcaattcccgattggtagaagaacttgctgtaatacacacgtactctgacgaccccgccccaacgactagcccctcctctgtgcaaccccgagagtttggggtcatgcagggggcgccacgagctcgtttcggaagccggaccccgcccgcagccgcagaagcctcgagtccacatctgggtctctaaagtctcgccgtagccagatcccggatccccaccttcttcaccagttcccgggcgtcctccaggcattggcgaggcagcctgtcaatcaggagctcgggcggcagccccccgcgcgggggctcggcgatgccagcctcagcgacaggcggcggcggcggcggccacggcacagacacacaccctcccacacgcgcgcaccagggcagacccggcgggcaggcggcggaggcaccctcggagcccggcgcccggcggggaggggacgtgctccgagggaccggccccgaggcgccggatggaggaagagatgcagccggcagaggaggggcccagcgtccccaaaatctacaagcagcgcagcccctacagcgtcctcaagacgttccccagcaagagaccggcgctggccaagcgctacgagcgacccaccctggtggagctgccgcacgtgcgggcgcccccgccgcccccgccgcccttcgcgccgcacgccgccgtctccatcagcagcagcgagccgccgccgcagcagttccaggcgcagagctcctacccccccgggcccggccgggccgccgccgccgcttcgtcgtcgtcgccgtcctgcacgcccgccacatcccagggccacttgaggactccggcgcagccgccgcccgcgtcccccgccgcctcctcgtcgtcttcgttcgccgctgtcgtcaggtatggcccaggcgcggcggcggccgccggcaccggcggcacgggtagcgacagcgccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaaggtcagtgcagtcaggagagacaggtcccgaaagacgccctctggatccagttaaagtaacatgcctccgagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgagagtccaaagcctgtcattctgccatagtctacacattctcagctgccacagtacccaaatagaaatccattttagggttgtttgggaagtctgtggcacctacaacagacttttggaatattatattataaaaagaaaaaactacatctgatttttaaatgattactagctagatcatgagggtgaaaaaataggtgagctcctagttacctttctgaaatcttcaaactctgctacctgggcagagatagtccccaaggtaggctggggtagtgtttctgcccatgggagaaggtggagacatggagttgtgttaagggacaagaagcaaacattctcttaattcaaataagttgtctttatgttttccaaagacttgacttcatatttctcggcaaagacataggatagatgacatcatataccattttgacattaataatgtctattactaaaaggaaaccagagaacagaggcaacatctgcagacagtgattaattacaggtcaactgtttttctgttgtttaaaaaccactgtgttgatcaagaaggcactatttgatctctggagtttacaaacagtagtcatttttcattgttagtcaagaaacatccaaagatccaaaaccattttcaaatgctcagttttgtaggttaataaatccgcagtttccatagccttaaatcaggctttgttgacacaatgccaaagtgatgggtagaacaatgaaaatttaaagcaattagttgtttggtgcactgaagaccaaacaagtggtgtgactgatggtattcgctgaattgactagatgttctggcattgtatacacacagcttcaaggcgattctgacaactatgcaatgggcttgtcagtaattgctctgaaatttgagggtctttctctgctgagctgatctttagaatttgtatgaaacttgtttcccattgtccttgatgaaaacatttcatcccctccgtgcctcctttaccccaatgtaccccttagctatggctaagtcagcactgtgccgctatcccctggttaatttgttgagttccatatgtgaaattagtggtatctttggaaactttccatattggcaaatgctatagaggtgctagagtcatcatttctgagggcttcctgtttggactcaggagaggctttctttaccaaactagtccagattactacattctttgtagagcaaagggctaaatggacagcgtttattgaaggctactaatgtcatctacagacatgaccaagggtttttgaaaattggttggagattcaggttaatgagcatccattgataaagggtttttgggctatttttgtcaacataaactcataaattgtcctttagatttaatatttagtttgtattcactatatacaaagtcctagaaacaggtctttctgtagcttttgtttattagcttttttgtattactagaattcatccattgaaaagtttaatgtttatggaggtggtcatctgtcagatctgctcaatgatgtagtgggcactaatatttcaatcctgttttgagaaaattaactaaaatttgtcatatcattcaatggaatagggagaaccaatattcaattctatttggggcaaattagctaaaatttggaagtaaaagaaatgatatgggcaaatgccatgttcttacggcagccatgagaccagtctctttggctctccaaggaagaaagatacctcttaaagcattttttagaggtccgagaagtcagtgtctgtcttataagattctttgacaacatgacatcttcgctagaagaaaaacaccaccatagcctcatctgtttttccatcttaccttaatttttcattggccttaagttgtccttactgctgaatacatcgttctgtttttctaaagcaacaatatttgatcactgcttttaagaaaaacagactagcccttcttgtttttctggaagtttgagagtcctgaatatttcttcatatccaaatatcatcttggagccctatcgtgctggtcttcgctgaggctgatgagagcactttctgcacccctgctccatggccgtacatgacaacgcacctgcaccactgctgcaagggcggggggcagcagcctgtgttttggctgtcactgttacctcctgagaaggctgctgtcccaggtttgcacaccacttttgttccaaagttacacatggtctcttcctccctcgcacccattccaggttaatcatttctctatcagctgtttctccatccacagattctgaatgttgagactaattgttgggcatctcttttgcacaaggctgacagactccatactcagcatcgcacagccagttctaactcctctgctgggtctcggacctacagcttttgcctgagtgaaatgttcctacgacttttgctcctgagtgagatattccattgtacttctactgtttgtgtatctgctgggttcctttagccaagcctagcgtctgacgcaggcactagccgccactgaggccgtgatacagcatcactgtggacactgctggctcctctccttgggacatatccacactgccccttgagcttcacctttaaggctggtatgtacgtaagttcacggtggtcgtctgcatggtctcctcttgtttaaatcaggaccaacaaaggatgttcatttgtattttggcaaggcccattgggcctctgtgtagccaggttaaaagctcactcactaggatcggatgctgtcattgctctgtgagcctttcagttgaaatccttggagacttgaaggtgttgcttattattttgatttgattttctgcatctttatctggcaaatggacagattgctctcacaagaaacttagtcatgtcagcttttagagtccttcttgagtcatgttagcattggtagtgtaaaatagattgagttaaaacagctcaggatgcagctgtgcccccacttaattggtgagaggaggaggtcacggggctggcttgacaacaaagactaaatgtggcttttttgtcggtgactaggtgtggtccataagcagaagagccatacctacaaaaagtgacaactgtcctgtgttttccaaattaaaatcttgttacaaagatcatgccggcttttcgcagtgagttgaagccccaagctcagttccagccaggctcaggatgaccctcaaatgatatgtattggatagtgtaggtcaggagcctgtggaggggaccagtattttgcaagcagttactaaagtcacatttctcactgactcttgacggtgcattgttcaaaatctcatggcttaaccttagtgttaaatgctttcaagaaaaactgtaaccatttcaattttacaagtactttctcattttacttgaacattttacaagtactttctgtatttacttgtaaatatttcctctagcccttgaacccgcgcatcacttttttggttttcctcattccaccacagcatttaggtgaccgttaccatttatgtttcattaagcttcactaggaatgtaaggataatattagagcatttgcagaaaattgttatctccttttgtaggggattcgagacatatttgtagctacttcacggctgtagagttagtgggtgatcgggtattctgcattgttccttatccctttgtcagtgacagacacattgacataagagattcctacaggattataaggagagataaattattaaccatttttttacttgatccaactactccatgtcccatcaactagtggtaactgatgttgataggattttttttaagtccagtaactattcttgcagtatcagatgtttaccccaaattaggcaataacccagacttcgaatctgtaggtttatgattcctacattcccctgccgctctcaatggcttgttgcctcccttctgttgctctcagaaaacagatggagatcaggtaaagatgaaacgtgcactatatgttcagaaaagcaaacatccattgtcctcatttagattccatccttcaatttatgctctagaacctaaacctaatacccattgactacctcctgagtttcttaggtttcaattatttttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagaaccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacaataaatgtcaagtctctgttaa

SEQ ID NO: 111354 - DNA, 1348 bp, Homo sapiens
  Payload ID: 1806
  Gene Symbol: BEND4
  Gene Name: BEN domain containing 4
  ENST ID: ENST00000611697
  CDS Start-End: 53-1270
ggaggggacgtgctccgagggaccggccccgaggcgccggatggaggaagagatgcagccggcagaggaggggcccagcgtccccaaaatctacaagcagcgcagcccctacagcgtcctcaagacgttccccagcctggagctcagcgcagagagtcgaatgatcttggatgcctttgcccagcagtgcagtcgagttcttagcctcttaaattgtggaggaaaactcctggactccaaccattctcagtccatgatttcttgcgtaaagcaggaaggctcaagttacaacgaaagacaggagcactgtcacattgggaaaggggtccacagtcagacctcagacaatgtagacatagagatgcagtatatgcaaaggaaacaacaaacttctgcctttttgagggttttcactgactctctacaaaattacctgctctcgggaagctttccaactccaaacccctcgtcagccagtgaatatggccatctggccgacgtggatcctctgtcaacctctcctgtgcatacattaggtggctggacttccccagcaacgtccgaatcccatggccacccatcttcatctacactgccagaagaggaggaggaggaggacgaggaaggctattgtcctcgatgccaagagctggagcaggaggttatttcactgcaacaagaaaatgaagagctcagaaggaaattagagagcatcccagtgccctgccagaccgttttagattacttgaagatggttctgcagcaccacaaccaactcctgataccacagccagctgaccagccgacagagggaagcaagcagctgttgaacaactatcctgtctacataacgagcaaacagtgggatgaggctgtaaattcttcaaagaaagatgggagacggctccttcgatacctcatcagatttgttttcacaaccgatgagcttaagtactcatgcggccttgggaaaaggaaaaggtcagtgcagtcaggagagacaggtcccgaaagacgccctctggatccagttaaagtaacatgcctccgagaattcattaggatgcattgtacctccaaccccgattggtggatgccctcggaagagcagataaacaaagtgttcagcgacgctgtcggtcacgcccgacaggggcgggcggtggggactttcctgcacaacggtggctcattttatgaagggatcgatcaccaggcttctcaggatgaagtcttcaataaaagttcccaggatggatctggggattagtggacagaatcttcctgttgtagcagctggtcctctcaagagttccaattgtgaatgtcctgttcctgtcacctgaga

SEQ ID NO: 111355 - DNA, 1716 bp, Homo sapiens
  Payload ID: 1807
  Gene Symbol: BEND5
  Gene Name: BEN domain containing 5
  Uniprot ID: Q7L4P6
  ENST ID: ENST00000371833
  CDS Start-End: 88-1353
gagactcgcgccccccgccggatccccacctccgcgcccgccccgcgggctgagctgcccgaccggggcccgcccccggcgcccaccatgtacgcctttgtgcggttcctggaggacaacgtctgctacgcgctgcccgtgtcgtgcgtgcgcgacttcagcccccgctcgcggctggattttgacaaccagaaggtgtacgccgtgtaccggggcccggaggaattgggcgccgggcccgagagccccccgcgcgccccccgcgactggggcgcgctgttgctccacaaggcccagatcctggcgctggcagaagacaaatctgaccttgaaaacagtgtgatgcagaagaaaataaaaatccccaagctttctcttaatcatgtagaagaagatggagaggttaaagattatggggaagaagatttacagcttagacacatcaagagacctgaggggcggaagccgagcgaagtggcgcacaagagcatcgaggcagtggtggctcggctagagaagcagaacggcctgagcctgggccatagcacgtgtccggaagaggtcttcgtggaggcctcgccaggcacagaggacatggacagtctagaagatgctgtggtgccccgggctctgtatgaggagctgctgcgcaactaccagcagcaacaggaagagatgcgccacctccagcaggagctggagcggactcggaggcagctggtacaacaggccaagaagctcaaggagtacggggcacttgtgtctgaaatgaaggagctccgtgaccttaaccggaggctccaggacgtgctgctcctgcggcttggcagcggtcccgccattgatctggaaaaagtaaagtcagaatgtctcgagcccgagccggagttacggagcactttcagtgaggaagcaaatacgtcgtcctattaccccgctcctgcgcctgtcatggacaagtatatcctagacaatggcaaggtccatctgggaagcgggatttgggttgatgaggagaaatggcaccagctacaagtaacccaaggagattccaagtacacgaagaacttggcagttatgatttggggaacagatgttctgaaaaacagaagcgtcacaggcgtcgccacaaaaaaaaagaaagatgcagtccctaaaccacccctctcgcctcacaaactaagcatcgtcagagagtgtttgtatgacagaatagcacaagaaactgtggatgaaactgaaattgcacagagactctccaaagtcaacaagtacatctgtgaaaaaatcatggatatcaataaatcctgtaaaaatgaagaacgaagggaagcaaaatacaatttgcaataaactttggatttttcataaagctttcgtgttttccttgtgtggcatgtgatttgcgagcgatggtgccgtccaaatcagaccccaccgtgcatggtggtgtgtgtgcagggatccatcgggttctggggtcagcggcttgttctgaatgtggacactccaaagacgacagatggctttgctgagactcaggagcagcctggcactggtgtccttctgggaatggggaaaacactcttcttggagggggataaggttgcctgagttgcctgtcacttgactggggtttgaatggatatttttactatccaaggacttctttgttgctctattttgttctataataaattttcattaattctttga

SEQ ID NO: 111356 - DNA, 579 bp, Homo sapiens
  Payload ID: 1808
  Gene Symbol: BEND6
  Gene Name: BEN domain containing 6
  ENST ID: ENST00000370745
  CDS Start-End: 190-579
gctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaaggaaacaaactagatataacaacagagaagaccattttacatggaggcatgaaaactttgaatgttgttaccacaagcagtcacccagtttga

SEQ ID NO: 111357 - DNA, 2379 bp, Homo sapiens
  Payload ID: 1808
  Gene Symbol: BEND6
  Gene Name: BEN domain containing 6
  Uniprot ID: Q5SZJ8
  ENST ID: ENST00000370746
  CDS Start-End: 270-1109
ctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagtgttaccacaagcagtcacccagtttgaagaattggttggtatggccgaggctctgcttaagggtgggggaaccatgtctacatctgcatccaccctctggagagcaacaaacaactcctcgccagattcatttgcctcaacatgcagtaattctaattctaactccagttcaccagtttccttaaagcctgaggaagagcatcagactgatgagaaacagttccagattgaaaaatggcagattgcccgttgtaacaagagcaagcctcagaagtttattaatgatttaatgcaagtactttacacaaatgaatacatggccactcacagcctgacaggggcaaaatcctctacttcaagggacaaagctgtaaaaccagctatgaatcagaatgaagtccaagaaatcataggagtaacaaaacaattatttcccaatacggatgatgtttcaattaggagaatgatagggcaaaagctaaacaactgtaccaagaagccaaatttaagcaaaaatcttaactctcaggatattaaatagatccttttggtattacaggtatctgaaacaaagcaccttcaattctaaatctagcactggattttgttggagaatctgcagccttcctggcagtgagaaagacagacatgtgcagtgacaggctgtaagacatatgtaacattgctgagctctcctaagggaccaacaagcttgctgaagaagctgcatgtagattccaccctcagtactagtgatgcatcaaaccagagaatttctgccagtcaaataagcatgcaatatggtttctttggaaataagcatttcccaatccccaaatacccctctgtacagttaatctaacaggatagtcagagctcttatcatagcagccaaaacttcagcccataggttagtcattgtcctaaccaatcattgtacattgattattaccagtgacttcccattatagtttttggatctttagcataagcacatgcttgcaaaagtaaacagtgaaataattaatgttggcaaatatgagaacaacaaagtcagcccaaaatctgataatcatgtctaaccaagtaataatgttttagcaataaaattacaggattattctgttatctaaaaatgtataaaatgggaatatgaaaaaaatgacaacagcaagatgttttattttaatgttaagcaattccaccacacttctgaagaataaacctaagtttttgtgattgttaaaacaatgcatcaattttcagggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagaggatgctacagtagtttcaaagttcagtgttgtggacccaggaaattttccataagtcttgcttgataacaatgtgattgtacaaaataaatgttcttaaggaaacaacttatgtaacatttgctacctttatgtaaacataaataaatcccatttaaaagat

SEQ ID NO: 111358 - DNA, 3497 bp, Homo sapiens
  Payload ID: 1808
  Gene Symbol: BEND6
  Gene Name: BEN domain containing 6
  Uniprot ID: Q5SZJ8
  ENST ID: ENST00000370748
  CDS Start-End: 436-756
ggcagcgcgggcgcgcggacatggctgcggcggtttcggcggcgtccgcgggctgcacccgggcctgagagcccagcgccctcccgcggggccgcccgccagtccgcgccgtccgcgggtgcattggccgggtgcctctagcttcccggacacccggagcttccgcctatccagcctccctcggccaaattgctgcggagcccgtcgtcagggggcgccaaggagccagggggaaaaccgagaggcgctgacaggagcctcccggcggtgctaccctccacctcccacctccctgcgccccgccccgaggttggggctttgaagaatgcagccggggaaagcattaacttttgagctacgtccagaatagcatcatcttcatgggtattccctactcctaggatttcagaaaacctttgataactaattgagaaaatgcagaagatcgtgcagacagatgaaattaccaatacacaagcttttagaaaaggaaagaggaaaagaacagagacaatggactcagaaaatgcaaatagtgacatggataaaggacagagagacccatattcgggaaatgcctttctgcctggtgaaagctccagtgaggatgaagagcctttagcagaattgtcaaaggaagaattgtgcgccaaaataaaaagcctgaaagaaaaactaacaaacacccggaaagaaaacagccgacttcgacagtctttggtcatgcttcaagcttggtccagagagctgccttagactctccaatgaatgtgttcaaacagctgcctctgttaccttgactcatctcagatacgggtcctggtgctaggaatcaaagactgtctctattattttggcttgctccaggttgggcagaagcccatgcaaggctactactgatcatgtttcatttctagctttgatgtctgggcactgatttccctaggtttaactatttgctcaatgtcaaggcagtgctgtggaaatctgtctgtgtaactggagtgctatgcagacctgtctgtgtgactgtcatgcaggcctgtctgtgtgattgtcagggagaattggcctgccacaacttcactgcagcctgggtgacagacacagacaccatctcttaaaaaaagaaaaaagaaaaaaaaataggcaaatgatctgaacagatatttctcagtaagacatacaaatggccaacaggtatatgaaaaaaatgctcaacatcactgatcaccagggaaatgcgtatcaaaaccacagtgaggtaacatctcaccccaggaagtatggctattatcaaaaagacaaaaacaaaacaaattctagtgaagatgtggagaaaagcgaactctaatacactgtgggtatgaatgtaaaccagtgcagccactatggagacagcatcgttcacaatagataacatagggaatcaacttaagtgtccaacaacagatgaatagataaagaaaatgtggcatatatacacaatggaatattattcatccataaaacagaatgaaatcctgtcatttttggcaacagggatgatcattatgttaagtgaaataagcgaggaatagaaagttaaacactgcatgttctcatttgtatacggaagctaaaaagaaaaaggttaatctcatagaagtaaaaagtagaacagaggatacaagaggctggaaagggcagggggaagggaaaggtagggagagatttattaaaggatacaaaattacagctagatgggaagaataagttctaatgttcaatacccctgtgggattactatagttaacaatagtatatattttcaagtagctagaaggaggattttgaatgttcccaacataaaaaaatgataaatgtttgcagtaatagatatgctaattaccctgatctgacctttatacattatatgtatcaaaacatcattatttgccctatgaaaatgtataattaaaatattaaataaaatcaaattttaaaaaaggattttctaatatggttccctgagtagtcctagaaacaggaactcaatagccaagagcactcctagcaattagatgtgcccttgtaatatcattaaccattaaagggaacgatgactccttggataaatggctgattccatgtcttgcatacaaaatatacaaaatgagacttgtgaagaagcttgagcaggaaatatacaggaacatcttgtcatatcagaaagcaaggaagttagaccatgcagatgtgtcaactagaagagcttcccacaagccaaagatgggacagtttgagcatgaataagaatgacaaccacaatagatagacacatattgtattgatatatgtttaatgcatgagttcacagtggtattcaaaaaagaagaaaacgttatggtcatctgaaaacaaccaactcataattttgaaaattggcagatacaaaccaaaatcaagcgtgtatcctgccattactatatgaaatgaacttctgggtaaccaaacagttgataagaggaactttccctttgtagaactccagctaataaatgaagaaaataattagaatatcactattttgcaagccattgtgacataatgaatctatgcagtgaccatctgtagctggtaagatcacaaaaaagctaaccaggcattaaataccacctgatggaagttaaaacagtacctgaatccgatcaacccttcagatctaactaccaatctacatcaaatacagggaacaggagaatatgtcaaataccacctaaaggtgcaatcacagcaaaatccgactgtaggaaattctccaggacaaatgacccagtttctacaattaataaattgcaagggaaaaaactaggaagggagaggaaacctatagtttatatggaagagacagcaaccagttgtaatgtatagtccttactggatcttgattcgaacaaacttaaaaaataagaccatcagagaaatttgaacattgactaaggtttttttaaacgatattaaaaaactattgttaactatttctggctgcagtagtggtgttaacagttataattttaaatacaccttttagagatgcctacagaaatatttacagataaaaatgagatgatgcctgtgctttgcatcaaataatttgggggataaaggggatcagggtataagtggattgagacttgccatgaattgaaatgggagaatttgctatttttgtttctgtttaaaattttccattaaaagtttaaaaaatatatccaggaaaacagcctacttatgaaaagatatttaaattctacaaaattgttggtgaatatttaactgatctgagtgatgaatgagtaagtataaaataaatggataatatactaagaaaagactgctactttcaactaaaatgaaaatttaaattatgtgtgtttaaaatgttataaaattaaaagataaacactttgagaaaaatatttgcaactcaagaaaaataaaagattaaaatgctt

SEQ ID NO: 111359 - DNA, 2239 bp, Homo sapiens
  Payload ID: 1809
  Gene Symbol: BEND7
  Gene Name: BEN domain containing 7
  Uniprot ID: Q8N7W2
  ENST ID: ENST00000341083
  CDS Start-End: 298-1704
atcctagcattatatctacagagcagaggcaggacctttggcaggagacacatcccttctcctgtgatgtgtcagttagtgtagagaagcaagctggcatggacttgagagccggggtgatgtctccagcggcagcgtgtcatcctggaggacattgtgtcagcagtgaagccctgcatccctgccagtcatcctgaaggacattgtgtcagtagtgaagccctgcgtccctgccagtccaggctttcttccttgtccttgccccgcctggtgaagctgacagacagagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagcagagatcgcggacagtgatgaaagactggacggcattgctctaccaccaacaggtgcttgtggtgggccctgcactgttctgccgggtgggagtgcagcggtgaccctagtcttgcagagctcacctcagacaatgtcacaagaaaagggacagatggcagaaccctgggaggagcagcatctcgtgctcctgaacaaccttaccagagacagagctgaaacaggagctttgtcccaaaccagccaagacttcaagcaccattcattcctcataactcaggtctcagctacacttcatcatcagagagggattcgcaactttcccacgccaggctcagccaagtctcttacccttcacatctcttgcctctctctctgaaattatcttgcttatttatgtgtgtgtgtatcacccatctttccactggaatctgagccttgtgatgtcaggctgttaagatttcaggccctggtgaaaacatgttcaggatgccctctctcccctttgcccagcaagagtggactgattaaagttggacctgaggtttccatgaatatgcaaccgagtcattctgacgacagtgagtcctggcctcccagtgctgccagttaccagaagtgactccccttctcccatcagcccaaacccagagcctttatcacagaacccaagattgagaggagggtcaggctggttggacagtggccttatcatgggatggatggatcaggagccttttacagcgctctcctttccgctgtatcccattgtcttagatcacgtggacttgccttttcccctaataccgccccctcagtgctcttctataattggagaaattgtgtcaatagatcgaccaaagagatgcaggttgtactccatgagaatttaataaacgctagcgattcaaagc

SEQ ID NO: 111360 - DNA, 1609 bp, Homo sapiens
  Payload ID: 1809
  Gene Symbol: BEND7
  Gene Name: BEN domain containing 7
  Uniprot ID: Q8N7W2
  ENST ID: ENST00000378605
  CDS Start-End: 97-1221
ggacctttggcaggagacacatcccttctcctgtgatgtgtcagttagtgtagagaagcaagctggcatggacttgagagccggggagatgaaagcatggaaataaaaaagcaaattacagggatgagaagattgctgaacgacagcactgggcggatctatcagcgagttggcaaagaaggagagaaactaaaagaagagccccaggacctggatttagtctggcctccacgtttgaactcctctgctgaggccccgcaaagcctccacccgtcttcacgtggtgtgtggaatgagctaccgccccagagtggacagttctcagggcagtatggcacccgttctagaaccttccaaagccagccccaccctaccacgagctccaatggtatggttgtcaacaaacattcagaaggctctcatgggggagaacttccagtggtgaattcatcagctggatcaaactgctgtacttgtaactgccagtcaacgttgcaggccattctacaagaactcaagaccatgaggaaattaatgcaaattcaagcagttggaactcaaaacagacaacaacctccaatttcccttatatgctcccagcgaactgctgtctcacgaaagagaaataaaaagaaaaaagtgcccccaaagactgtggaacctcttactgtgaaacagaagcccagtgggtcagagatggagaaaaagtcggtggtggcctctgagctatctgctctccaggcagccgagcacacctccccggaggagagccgcgttctaggattcggcattgttctggaatcaccttcctcagatccagaagtacaacttgctgaaggctttgacgtgtttatgcctaaatctcagctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtga

SEQ ID NO: 111361 - DNA, 6524 bp, Homo sapiens
  Payload ID: 1809
  Gene Symbol: BEND7
  Gene Name: BEN domain containing 7
  ENST ID: ENST00000440282
  CDS Start-End: 1-354
ctggactctatattgtcaaactacactcgctcaggaagccttctgtttagaaaactggtgtgtgcgttttttgatgacaagactttggctaactccttacccaatgggaagaggaaaagaggactcaatgacaaccggaaaggactagaccaaaatattgtgggtgcaataaaagtcttcacagaaaagtactgtacagctaaccatgtggataagcttcctggcccaagagattgggtacagattctacaggatcaaattaaactggccagaagaaggttaaaaagaggctcagagatcgcggacagtgatgaaagactggacggcattgctctaccaccaacaggtaaataaaacgcatttacattttcatcacctcctggaaaatacagcccacaaaactatttgcattgaaaacgattttaacattagacatgcagacacttgagcaaactgcttctgcagtggaccaggccccgtcattggagcttctcaaggccccgtactcagagatgtttttcatactgaatagaaaaacgtttttctcacactcttattttcataaaaatctcagaagagcaaatcctaagaactaagtatcataacattttgcctccccaaacctttggacattacaaaatatttttaacgtgaaatgagatttcaccttaaaacggggaccactaattttgtgtgatcaaattcatggctaggctgtcctctcccacctcctccaaacggccttggagccttgagcagtcaatcagtggacacccagtgaatactatgttttaactgagcgatttgaacaaggccagccatccggcgtgagtggcacattcctaataccaggaccagatcagctgaagatacccttccatggaagcatttgctgcacgctgttgtgttaagccatagacataattccaacttcatgttatttgactctcaagtaatgcttctgaccctggcttcctacctgtgtatgggttcatatctgagagccagaggggcaggtgtctgatcaatgagccttgtggaaaacaatgtatcccctccattggtcacaggactctactgacttccctccaaaggatatctgaagattctctgcccacaaaacccaggtacccccaaaaaccctcttactgaaaaggttcaaccgaatgttttttcctctagttttggggtggtctgtgttgattaaattcagcaaatattagtggagtctctaggttgtgtaggaacttgactaggccatgtattcattgacagcacatatcccaaaatggcaaggaaagccacattcgcaggcataggatgggcctgtgctagtgaacttcagagcttcagagcaacaggaaaattcagccgtgtaagagacacattgctttctctgccactgagtagctaagcaacagatcaatggacagataaatcaaatgagctacatagtgcaaaaagacctgcctacatcaagttcttcccatacagagtcattatataaaagagatttctgttcttctttggctgtgttttcacatttgtgaattaagagaattgaaatacgtgatctctgttgttccttcccaatttgtcattctctgaatatcagggcacgcatatcagcctcattcttatcacctgggcccaatcccagccgatccatgaaatcctaatcgtaatagacctagccttcagaaggcccttcaggggagcaccatgcctttctagctgtgcttcccaagtgccctcccaccctggccatctgcactgcctgtcctcctgtgtcatgtgacacagtgagcttttattatttgaaagccactccccttgaagtttatattcacccccaagtggtgagtacggaatgcctttgtattttcctatctgaagttggagatacgtttccagtgagaaaactgaggtcagagggtgctagaagagcctcatggaactgaaaaaaatgtcaaggaatctgagaatgagaaggaacttgagagatcctctagtccaatcccttctttttatccagtccttttattttacaggaaaaaaagcctgaggcccagaaacattaagtggctttcccacggcctcacagctggttgacggcctggccggaacccaggtccctcgactcccagccatgataccatatagctttctcatacctaagccaaagccagcttttctctgcatgtttcttaaagatcctaagagatgatggatgtgctaatccctttaggagtcctcttcactgtctcagtcttcacaattaaaatgttcgtcgtcagtcggcccggttcactgcagctgaaactcgtttcttccagtcttttctcaaactttacccaaggctgtgaggtcataatgaagaaaatagtataacacacttgcagatcttttcattaaactattgatagatatttgatacaaatcactaagcagcatgataaataaaaacgtttatcatttagaaaagaggaaaagaggccgggcgcggtggctcacacctgtaatcccagcactttgggaggccgaggcgggcggatcacaaggtcaggagatcgagaccatcctggctaacacggtgaaacccccgtctctactaaaaaatatataaaaaattagccaggcatggtggcgggcgcctgtagtcccagctactcaggaggctgaggcaggagaatggcgtgaacctgggaggcggagcttgcagtgagccgagatcgcgccactacactccagcttgggtgacagagcgagactccgtctcaaaaaaaagaaggaaaagaagtctcagattgatgctcaaattttgcagtaataatattaagtaatcttgatattcacctggatagcatgtctcttgattgcctccaaagtaaaatccccattctggttggcttctttgaatgcagtgctgctcctaacacccctcctcacatgtgccctttaaggactccacctttctcgcacatgtggtttcatccttgagcttgagcctcactggtcagaaccacaggatcgaccaagggctctgatacagactctcattatcccatttatctgagctagcaacagttagttctttttaaagattcaacaatgcttttattacttttttaaggtcttttttcctccttccaaagttgtgtatttgggggaagggcagggaaagggatgtaaatgcttaagtgtttctatgaaccagaagtgactagggtagggttacaggcaggtcaaatgacatttgtttggatgcattacatttaagcaaccttctgttcatcaggctttagcagaaatggattcaccttctgtagtgcatctattttagtttcccttaaccctattcactaagcctttttgagcaactaccaagaatcagccccgtgttgggtgctggtgtacaaatgccctcagactagtgtgagaggcagaaggaattacataaatgctatagcacagatgtgtggagagggtctggggctcaagaaaagccacccaggagctggggacaatttgcattaaaaaaaaaagtatagagaaagtgaaatcaaaacagtgctttctaaaatttaaaatggggcttccaaatttgaaatggggatgttcatctagacttagcaattgtcataaattggcattttacatacttttaaaaaattaataaaagtgtaaggaagaacatttcaattgcttttaccacccacagacaaccattattggatgatttttctcaaatgtttctccattttatttatttatacagtggagatcaaatatgtaaaattttgtttcctacatgtttttttgatttttacctaacaagcatttttccactctatggcaaatcttcatatgcattattttaatagctgcataatattctgttttgcaggtaaattatcttttaggccattttccatgactggacaatatgtggatatactctaatagtaacacacattcgtggcctttctcataaaaaatcattacaaatttccaatttctacaattgctcatggaggacaactaaagccttggctaaaaacttagcgacttaagtgtgaaacacagacacctccccagtaaattgtttacttgtccagaacgcccacctccagccatgtcacagaaccatgtacaactcttccttagagaagcggctctccgccttcattttcttgtctctgttgtaggtaatatatttgacaccaggagagaaaacacggaggacacagaaccaggtttcattgcctagactttgattttagtgacattgttgagtggcatatgtaacttccgtttgaatttccacaaagatccacgtagcatttcaggttcctgcaaagtgtgggtgttctgtcaagcttacctgtcatgtttgaatagtttcatatactttctttgtaatgtgtgataaccaagcctccaatctggtataagattttttaaatcatttttagggttgatttgttaccctttaaaagtccagcatatgattcagtgagttcattgtccattataaagaagtggttctctcttccctgttttcattcaaaacctcagtatgaatatagagctttgaaacgtatttattttaatgtaaattgcttagatgcagtataaaggagaatggctctttccagtgctgagagagcagttgtgaaggccaagattaattagaccttcatcatcttagaagatgaaaaagttgttttgggagataggatagctctgacctgtaagatgaaatcattcatgacgtcagtgccccccaaatagccatttgtaactgagtaagtgcaaatgacctatgagttcttaggaaagaaaaacctttcacctaagttgcgtcaacacaatgacaaaataactaattaaaaggtgagaaaaccagtaaattatctacatgatacctgacagccattttaacagatggtcttaacggagtgctacagggttttggcaccatgtggtaactagctaaaaatgtacttaatattatgtcatttatttggttcctagtatacttgccctccactttatataaaactaatttatgaaaatctggatttattttaaaaagatatcttgccatgaaggtatttgttttatagaaatatttacctccagatttctttctctaataagatggtgaatttaaaacactgtgttatttagaaacactgcatttacacttcatttattgtataaagcaaattgcattgaatcttcgccacttgacccaaaggccaaaaattggcatgagaacaatttggactacacatcaccaaacccggggttcacacctgtccactagcagttccagtgccttcccctagccctggatttggcaaagcacagaatgttaagagctaaaagttattgtagaggctactcagtcccacccgggaaactgaggatgaatgagggtaagcggttgcccagagcccgttaacccctccgtggctggggccctgcctagaacccgaatttcctgactaccctgtccaaggtattcatgtcacatcacactgaaacgctaaacctagagataggagaggccctctgggataaatccctgttccaccaaagaccagccagtcatcaaagatgagagaaggcatccctgtactgtaacaaaaagctggctttaggcgtggcttgtagaatcaatctaactactagacaagttacatctcatatatgtgtggcttctttttcttcttttggggggctacaaggaaggtttggagaaattatttccatcatacctttttgttagcctttttccatttctggccagtaagtaatcccgttcctgacaacagtccctttgttttctcaagtggtctgatgaaggactgcaaaccacagctcttgtgttttttgcaccatgggttttaaaatccgtcctctgcctcccacaaggagctactacccaagggaagggagaagattaattggtgacctttcgccgtgttaaaataggatgagtatgttgctggtcaaggcagaaacgctaacttccaactgtggtctgttaagagatctgctgggaaccttcagaagcactgccttccaaggcggggccacagcttggggtgttcagcacttgaggacgggtggagcttgttcaacccaaagatgtgtgcgatgaacggatctacacactggaaatacgtatcaaaactgcaacagcaaaatcatattttgtaaattaaaattgtgtttacttactgtgactactgttcagtctttattcagaaacctttttataggctttcttagcaaaaaaaaaatccatatctatggataatgtctcaatcttctgtatatatgttttattaatatgtaaatatttagattttttaaaattactatgttctttaaaaaagaattcaatgcaagcctggttgtgaaaatggtgtataacattgtgttgtggtatcaattcccaagatgctctttatgtctgatctggaagaatacaataaattactttaattgaa

SEQ ID NO: 111362 - DNA, 7483 bp, Homo sapiens
  Payload ID: 1810
  Gene Symbol: BZRAP1
  Gene Name: benzodiazepine receptor (peripheral) associated protein 1
  Uniprot ID: O95153
  ENST ID: ENST00000268893
  CDS Start-End: 841-6234
ctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaaatgggcagacagtgacacacagcaccacccccctcaacacacagaagtgggggcacccatcttcccaacacatgagacagcattgacctgcacggacagacctggagacacacacacgcaccctcacccaggcgcagctgtcggtggcctctgcacatcctccctacccccacagggacaccctcgctcctccacatactcgcgcacacacacagctaccagcaaacatagctcacatacccctggctccagctccagcagccctggcgccttctgcagcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 111363 - DNA, 5947 bp, Homo sapiens
  Payload ID: 1810
  Gene Symbol: BZRAP1
  Gene Name: benzodiazepine receptor (peripheral) associated protein 1
  Uniprot ID: O95153
  ENST ID: ENST00000343736
  CDS Start-End: 165-5738
agcctcctttgtgggtggggaagagctcagccaaccttggatggagcgtcggtgaagcaagagctcagaggggagaggggctggcctggcatgaccctcgccagtccccccacctggctgggtgatgtcccccggcccgggttctggggccccttggcagtaccatggagcaactgacaaccctcccacggcctggggaccctggagccatggagccatgggcactgcccacctggcatagctggactccaggtcgagggggtgaacctagcagtgcagccccaagcatcgctgatactcctccggcagctctgcagcttcaagaactgaggtctgaggagagttccaagcccaaaggagacgggagctccaggcccgtggggggaactgaccctgaaggagcagaggcttgtctgcccagcctgggccagcaagcatccagctctggacccgcctgccagaggccagaggatgaggaagtggaggctttcctgaaggccaagctgaatatgagctttggggacaggcccaatctggagctgctgagggccctgggggagctgcggcagcgctgtgccatccttaaggaggaaaaccagatgctgaggaagagcagcttccctgagacagaagagaaggtgcggaggctgaagaggaagaacgccgagctggcggtcattgccaagcgcctggaggagagggcccgaaagctgcaggaaacgaacctgagggtggtgagtgcccccttgccccggccggggaccagcttggagttgtgtcggaaggccctagcccgccagcgagcccgggacctcagtgagacagccagtgcactgctggccaaggacaagcagattgctgccttgcagcgggagtgcagggagctgcaggccaggctcactctggtgggcaaggagggtccccagtggctccacgtgcgggacttcgatcggctgctgcgcgagtcccagcgggaggtgctgcggctgcagaggcagatcgcgctgcgcaaccagcgggagacgctcccgctcccgccgtcctggcccccgggccctgctctccaggccagagcaggggcgcctgctcccggggccccgggagaggccacgccccaggaggatgcggacaacctacccgtgattctaggggagccagagaaagagcagagggtgcagcagctggaatcggagctcagcaagaagcggaagaaatgcgagagcctggagcaggaagcccggaaaaagcagaggcgatgtgaggagctggaactgcagctgagacaagcgcagaatgagaatgcccgcctggtggaggagaactcccggctcagtgggagagccacagagaaggagcaggtggagtgggagaatgcggagctgaggggccagctcctgggggtgacacaggagagggactcagcccttcgcaagagccagggcctgcagagcaagctggagagcctggagcaagtgctgaagcacatgcgggaggtggcccagcggcggcagcagctggaggtggagcatgaacaggctcggctcagcctacgggagaagcaggaggaggtccggagactgcagcaggcccaggctgaagcccagagggaacatgaaggagccgtgcagctgctggagtctaccttggattccatgcaggcccgggttcgagagctcgaagaacagtgccgcagccaaaccgagcagttcagcctcctggcacaggaactccaggctttccgcctgcacccgggccccttggatctgctcacatctgccctggactgtgggagccttggagactgcccaccacccccctgctgctgctccattccccagccttgccgggggtctggccccaaagaccttgacctcccgccgggctcccctgggcgctgcaccccaaagtcttccgagcctgcccctgccactctcactggggtccctcgaaggacagccaagaaggcagagtctctctccaactcctcccactccgagtccatccacaacagccccaagtcatgccctacacctgaggtggacacagccagtgaggtagaggagctggaggcagacagtgtctccctgctcccagctgcgccagagggcagccggggaggagccaggatccaggtcttcctagcacgttatagctacaacccctttgagggtcccaatgagaatccagaagcagagcttccgctgacagctggcgagtacatctacatctatggcaacatggatgaggatggcttttttgaaggagagctcatggatggccgaaggggcctggtcccttccaattttgtagagcgtgtgtcggatgatgacctcctgacctccctccctccagagctggccgatttgtcccacagctcaggccctgaactcagtttcctgagtgtaggtgggggtggcagcagtagcgggggccaaagcagtgtgggaaggagccagcccagacctgaggaggaggatgcaggggacgagctcagtctgagcccatcaccggagggcctgggcgagcctcctgccgtgccttacccccgccgtctggtggtcctcaagcagctggcccacagcgtggtgctggcctgggagccgcctcctgagcaagtggagctacacggcttccatatctgtgtgaatggggagctgcgacaggccctggggcctggggcgccacccaaggccgtgctggagaacctggacctgtgggccgggccccttcacatttctgtccaggccctgactagccggggcagctctgacccactgcgctgttgcttggcggtgggtgcccgggccggagtggtgcccagccagctgcgggtccatcggttgacagccacatctgctgagatcacctgggtgcccggcaatagcaacttggcccatgccatctacctcaatggggaagagtgcccacctgccagccccagtacctactgggccaccttctgccacttacggcctggcacaccctatcaggcccaagtggaggctcagctcccaccccaagggccctgggaaccaggctgggagaggctggagcagcgggctgccaccctgcagttcaccacactcccagcaggcccacctgatgcccctctggatgtgcagatcgagcctgggccctcccctgggatcttgatcatcagttggctcccagtcaccatcgatgctgctggcacatccaacggtgtccgggtcacaggctatgccatctacgctgatgggcagaagatcatggaggtggcctcacccacggcaggcagtgtactggtggagttgtcccagctgcagctgctgcaggtgtgtcgtgaggtggtcgtgcgcaccatgtcgccccacggggagtcggcggactccatcccggctcctatcactcccgccctggctccggccagcctgccagcccgagtctcctgcccctcaccgcacccaagcccagaggccagagcgccccttgcttcagcctccccagggcctggagaccccagctctcctctccagcaccctgctccccttggaactcaagagcctccaggagcaccccctgcaagcccttccagagagatggcaaaagggtcccacgaggaccctccagcaccttgctcccaggaggaggctggggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaagtcccagcccgaccccttttgtgagactgacagcgatgaggagatcttggagcagatcctggagctgcccctccagcagttctgtagcaagaagctctttagcatcccggaggaggaggaagaggaagaggaggacgaggaggaggagaagtcaggggcaggctgttcttcccgagaccctggcccgcctgaacctgcattgctggggctgggctgtgacagtggtcagccccgaagacctggccagtgtcccttgtctcctgagtcctccagggctggagactgcctggaagacatgcctggattagttggtggaagcagccggaggagaggagggggctcccctgagaagcccccaagccgcaggcggcctccagatccccgagaacactgcagccgacttctcagcaacaatgggccccaggcctctggacgactgggccccacacgggagaggggtggcctccccgtaattgagggccccaggactggactagaggctagcgggagaggccggctgggcccttcccggaggtgctcccgtggccgggcgctggagcctggcctggccagctgcctttcccccaagtgcttggaaatcagcattgaatatgattcggaggatgagcaggaggcgggcagcgggggcatcagcatcaccagctcctgctaccctggagatggggaggcctggggcacagcaactgtaggaaggcccagggggcctccgaaggccaattcaggccccaagccctacccacgcctcccagcctgggagaaaggggaaccagagcggagaggccgcagtgcgacgggcagagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagggaatggtccgtttgtgtactccacagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcagagaacgaggaggagaagagtccagtgctagatggagatagatatatgtagagagagcaacatgactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggag

SEQ ID NO: 111364 - DNA, 1553 bp, Homo sapiens
  Payload ID: 1810
  Gene Symbol: BZRAP1
  Gene Name: benzodiazepine receptor (peripheral) associated protein 1
  ENST ID: ENST00000581675
  CDS Start-End: 1-516
cgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcaggactggggctgcaccacacaagggtccccagggcccccaggtgggccttgtacccccagctctggcagcgcccccaggattgaacgtggggagccccagggcagaagcgagaaggtgtggggtttcttctccaaggggaagcagctcctcaggaggctgggctctgggaagaaggagtgaagctgtggcccatcctgcaggcagaagaggccctgagaggcccccagatcactgtctctgctgagcagggaaggctcagactgggcccagagcccccgttcttctgcgttaacactgtggcattcagagggaatcaaagagccttggtgaaggtcagagctaaatggctccttaaggatgaactctctagagaagcaccttcctcctacaggaggggaaactgagcccacagtgagtatgtaacttgaccaaggtcactgagccaggactggacccaggaccctcgcgtcctggtccacccacctcgtctactagtgtcccacagtgctgcgctagtcccttctgccacccttcccagtcccaggacgggccctggagggagaaaggagcctgtgccccctgatggctctggctgtcctgatcctgtcttccctcccctgaaggaaagtttgcactggattttattggagccccatctccccagcgggcaggcgggcggagcctgtatatatgtatatactcagtgcctcagttcagcttcctccacctcgcttccactgcacaggcccaggaaggagaaaggccaagccaaagtgggccccaccctgcccccgtcgtgctccatccttccctgccggggcctgctggcccctgtaaggtcccgcccccaaagaccctggggccagcggggccgaaagcggagttgggtttgccttattttgctcattggattcaagttcttttgcatagttttcttctaacccctgttggagtccaggggctggagaaaaggacagatttatgcagctattttcatacattccctgttcagagtggggtaggggttctccgccgttacccgatccactccatcccccaccctctgaggggtgagtgtgtctttgcatgtttcctttgctgtggtgggagatagtttgactgaacccccaccttgaccttggtctccaggggtgtggaatggtgggggaatttgtttaaaaagacattttattataataaagtctattttcacaaaa

SEQ ID NO: 111365 - DNA, 887 bp, Homo sapiens
  Payload ID: 1810
  Gene Symbol: BZRAP1
  Gene Name: benzodiazepine receptor (peripheral) associated protein 1
  ENST ID: ENST00000582679
  CDS Start-End: 1-887
ggcagcagtgctgggcacctcagaggagaggacagccagcacatctaccctgggtgagaaggaccctggccccgcagctccctcactggccaagcaggaggccgagtggactgcaggagaggcctgtccggcctccagctccacccagggagcacgggcccagcaggcgccaaataccgagatgtgccaaggaggagacccagggtctgggctgaggcccagggctgagaaggaggacacagcagagcttggggttcatctggtgaactccctcgtggaccacggccgcaactcagacctgtcagacatccaggaggaagaggaagaggaggaggaggaggaggaagaggagctgggttccaggacttgctccttccagaagcaggttgctggcaacagcatcagggagaatggggccaaggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagcccacacaactgggcctcctcccaagccccgccgctccaagaaag

SEQ ID NO: 111366 - DNA, 809 bp, Homo sapiens
  Payload ID: 1810
  Gene Symbol: BZRAP1
  Gene Name: benzodiazepine receptor (peripheral) associated protein 1
  ENST ID: ENST00000580669
  CDS Start-End: 1-809
gagccaaggagccactctcccgggcaacagagaccggagaggccagagggcaggacggctctgggcggaggggcccccagaagagaggtgtccgagtcctcaggccaagcactgcagagctagtccctgcgaggagcccctcagaaacactggcttaccagcacctacccgtcaggatctttgtggctctgtttgactatgaccccgtgtcaatgtcgcccaatcctgatgctggagaagaagagcttcccttccgagagggtcagatcctgaaggtgtttggggacaaggatgccgatggcttctaccagggcgaaggtgggggccggacaggctacattccctgcaacatggtggctgaggtggctgtggacagccctgctgggagacagcaactgctccagcggggttatttgtccccagatattctccttgagggctcagcccacacaactgggcctcctcccaagccccgccgctccaagaaagctgagtcggaaggccctgcccagccctgtccaggcccccctaagctggtcccctctgctgacctgaaagctccccactccatggtggctgcatttgactacaacccccaggagagttcccccaatatggacgtggaggcagagctgcccttccgggcaggggatgtcattactgtgtttgggggcatggacgatgacggtttctactatggggaattaaatggacaaaggggcctggttccatccaacttcctggagggccctgggcctgaggcaggcggcctggacagggaacccaggacaccccaggctgagagtcag

SEQ ID NO: 111367 - DNA, 1364 bp, Homo sapiens
  Payload ID: 1811
  Gene Symbol: BSCL2
  Gene Name: Berardinelli-Seip congenital lipodystrophy 2 (seipin)
  Uniprot ID: Q96G97
  ENST ID: ENST00000278893
  CDS Start-End: 219-1082
acttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagctt

SEQ ID NO: 111368 - DNA, 1712 bp, Homo sapiens
  Payload ID: 1811
  Gene Symbol: BSCL2
  Gene Name: Berardinelli-Seip congenital lipodystrophy 2 (seipin)
  ENST ID: ENST00000301781
  CDS Start-End: 324-1157
gaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtaacctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccc

SEQ ID NO: 111369 - DNA, 1683 bp, Homo sapiens
  Payload ID: 1811
  Gene Symbol: BSCL2
  Gene Name: Berardinelli-Seip congenital lipodystrophy 2 (seipin)
  Uniprot ID: Q96G97
  ENST ID: ENST00000360796
  CDS Start-End: 204-1592
agtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagctt

SEQ ID NO: 111370 - DNA, 1516 bp, Homo sapiens
  Payload ID: 1811
  Gene Symbol: BSCL2
  Gene Name: Berardinelli-Seip congenital lipodystrophy 2 (seipin)
  Uniprot ID: Q96G97
  ENST ID: ENST00000407022
  CDS Start-End: 248-1444
tacaaaagcggccggcggagaggggcgggacttccccgggagccggaagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaata

SEQ ID NO: 111371 - DNA, 326 bp, Homo sapiens
  Payload ID: 1811
  Gene Symbol: BSCL2
  Gene Name: Berardinelli-Seip congenital lipodystrophy 2 (seipin)
  ENST ID: ENST00000403098
  CDS Start-End: 1-240
gtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagctctgaacctgctgggggtgctctccgacagcgccccacctgctctagttcctgaagaaaaggggcagactcctcacattccagcactttcccacctgactcctctcccctcgtttttccttcaataaactattttgtgtc

SEQ ID NO: 111372 - DNA, 1984 bp, Homo sapiens
  Payload ID: 1811
  Gene Symbol: BSCL2
  Gene Name: Berardinelli-Seip congenital lipodystrophy 2 (seipin)
  ENST ID: ENST00000405837
  CDS Start-End: 498-1892
cctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccaggtgcagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 111373 - DNA, 1693 bp, Homo sapiens
  Payload ID: 1811
  Gene Symbol: BSCL2
  Gene Name: Berardinelli-Seip congenital lipodystrophy 2 (seipin)
  Uniprot ID: Q96G97
  ENST ID: ENST00000403550
  CDS Start-End: 425-1621
cggcgggctggtttccatggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggcaagtcgcacattctctccgtgcagctgcctagcagtgtggattcagtatcaccgtgtgtgtaaagctctttctaagaatcgtaaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaata

SEQ ID NO: 111374 - DNA, 578 bp, Homo sapiens
  Payload ID: 1811
  Gene Symbol: BSCL2
  Gene Name: Berardinelli-Seip congenital lipodystrophy 2 (seipin)
  ENST ID: ENST00000413908
  CDS Start-End: 269-388
ctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggagatgcctacaggtcctaggagctgtgggcgataaaaatcagcgccagctggatgaccgcctcactcggccgcttcgcgggtgaaatggcctgtggtgaaggaaccaccagctgctgcatcccatggccaggggtggcgtccaggtggcagagcagctaggaacgcaaggcctgaacctggggccagacaccctgctctcccggccatggtcaacgaccctccag

SEQ ID NO: 111375 - DNA, 545 bp, Homo sapiens
  Payload ID: 1811
  Gene Symbol: BSCL2
  Gene Name: Berardinelli-Seip congenital lipodystrophy 2 (seipin)
  ENST ID: ENST00000449636
  CDS Start-End: 1-453
ttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatgtgtctgggtctgacccctgcattccccttttggctgcagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 111376 - DNA, 1440 bp, Homo sapiens
  Payload ID: 1811
  Gene Symbol: BSCL2
  Gene Name: Berardinelli-Seip congenital lipodystrophy 2 (seipin)
  Uniprot ID: Q96G97
  ENST ID: ENST00000421906
  CDS Start-End: 192-1388
tacaaaagcggccggcggagaggggcgggacttccccgggagccggaagtcccgtctcacggttgccctggcagcgcgcgaggctggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctc

SEQ ID NO: 111377 - DNA, 992 bp, Homo sapiens
  Payload ID: 1811
  Gene Symbol: BSCL2
  Gene Name: Berardinelli-Seip congenital lipodystrophy 2 (seipin)
  ENST ID: ENST00000448568
  CDS Start-End: 322-992
atggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcag

SEQ ID NO: 111378 - DNA, 794 bp, Homo sapiens
  Payload ID: 1811
  Gene Symbol: BSCL2
  Gene Name: Berardinelli-Seip congenital lipodystrophy 2 (seipin)
  ENST ID: ENST00000464544
  CDS Start-End: 516-794
agtgattcttcgttatggccgcccgtgtgccttcgactcaatcgggaggacaccgaaatccagatttcggggttgcagggcgcgggccccggcttggttagggcaggggcagccattttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctg

SEQ ID NO: 111379 - DNA, 865 bp, Homo sapiens
  Payload ID: 1811
  Gene Symbol: BSCL2
  Gene Name: Berardinelli-Seip congenital lipodystrophy 2 (seipin)
  ENST ID: ENST00000524862
  CDS Start-End: 187-865
ctctgatctccgatccttgacgatgtctagcctgcattgattggcccttttccctggggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactgg

SEQ ID NO: 111380 - DNA, 585 bp, Homo sapiens
  Payload ID: 1811
  Gene Symbol: BSCL2
  Gene Name: Berardinelli-Seip congenital lipodystrophy 2 (seipin)
  ENST ID: ENST00000533982
  CDS Start-End: 288-585
acctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgc

SEQ ID NO: 111381 - DNA, 539 bp, Homo sapiens
  Payload ID: 1811
  Gene Symbol: BSCL2
  Gene Name: Berardinelli-Seip congenital lipodystrophy 2 (seipin)
  ENST ID: ENST00000530009
  CDS Start-End: 455-539
agtgattcttcgttatggccgcccgtgtgccttcgactcaatcgggaggacaccgaaatccagatttcggggttgcagggcgcgggccccggcttggttagggcaggggcagccattttgagaccagaagagggcggaagggaccatattgagaacgccggttgcctgggggccgccattttaagagaagccctctctgaagacctcaaccaaccctgatgaggagggcacatcacccctgtctgctccagtgagccccaacaggagaaaaacaggccattacttacctgaagccacaagcggcagtagcagccctgggtgtaggggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagagg

SEQ ID NO: 111382 - DNA, 662 bp, Homo sapiens
  Payload ID: 1811
  Gene Symbol: BSCL2
  Gene Name: Berardinelli-Seip congenital lipodystrophy 2 (seipin)
  ENST ID: ENST00000532818
  CDS Start-End: 294-662
attttgagaccagaagagggcggaagggaccatattgagaacgccggttgcctgggggccgccattttaagagaagccctgtacggtaaactccgtgacgtgggggctgccatgttggtacggccatcttggaatgggagtggctgtgggcgcagccatcttagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgaca

SEQ ID NO: 111383 - DNA, 844 bp, Homo sapiens
  Payload ID: 1811
  Gene Symbol: BSCL2
  Gene Name: Berardinelli-Seip congenital lipodystrophy 2 (seipin)
  ENST ID: ENST00000531524
  CDS Start-End: 512-844
tccgcccctaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggag

SEQ ID NO: 111384 - DNA, 553 bp, Homo sapiens
  Payload ID: 1811
  Gene Symbol: BSCL2
  Gene Name: Berardinelli-Seip congenital lipodystrophy 2 (seipin)
  ENST ID: ENST00000528874
  CDS Start-End: 484-553
agagtctgacggggccctgctgtgggtggagcaaagggtgcctcatatctctggggtgcttggggtcggccacaaaggtggtaggaaatggggtcgacagataggtgagggtgggccttgtgcttcagataacctcacatggtcaggcaagggttagggatgggatgcaaggagcctaaggggctcacaacaattactgacctaaggaagggcccaggagagggaaaagggaggagttgtgagaagggacaggggagctcagaggagagcacagaagaacttcttctcccggaaggggttctccgaagtgggcacaggggtgatgaggggatcctcacaggcgtgggcatcacaggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaag

SEQ ID NO: 111385 - DNA, 154 bp, Homo sapiens
  Payload ID: 1811
  Gene Symbol: BSCL2
  Gene Name: Berardinelli-Seip congenital lipodystrophy 2 (seipin)
  ENST ID: ENST00000525000
  CDS Start-End: 1-154
tgcggagaccagatcaaaggaccggacaaagaggaggaccgactgtgattcctccaccacctcactctgctccttccctgttgccaatgtctcgctgactaagggtggacgtgatcgggtgctgatgtatggacagccgtatcgtgttacctta

SEQ ID NO: 111386 - DNA, 2740 bp, Homo sapiens
  Payload ID: 1812
  Gene Symbol: BEST1
  Gene Name: bestrophin 1
  Uniprot ID: O76090
  ENST ID: ENST00000378043
  CDS Start-End: 644-2401
agataagggcactgaggctgagagaggagctgaaacctacccggggtcaccacacacaggtggcaaggctgggaccagaaaccaggactgttgactgcagcccggtattcattctttccatagcccacagggctgtcaaagaccccagggcctagtcagaggctcctccttcctggagagttcctggcacagaagttgaagctcagcacagccccctaacccccaactctctctgcaaggcctcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtt

SEQ ID NO: 111387 - DNA, 4267 bp, Homo sapiens
  Payload ID: 1812
  Gene Symbol: BEST1
  Gene Name: bestrophin 1
  Uniprot ID: O76090
  ENST ID: ENST00000449131
  CDS Start-End: 87-1901
caccagcctagtcgccagaccttctgtgggatcatcggacccacctggaaccccacctgctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacaggtctgtcctccacctgaaccaggggcactgcattgccctgtgccccaccccagcttcccttgctctgagcctacccttcctccacaatttcctagggttccatcactgccagagcacactggacctacgcccagcactggcttggggtatatacttggccaccttcacagggatcctagggaagtgttcgggaccttttctcacttcaccctggtatcacccggaagacttcttgggaccaggtgaaggaagatgaggttgtgctgaccagaatgctgctggagaactgccccagggctgacaggccaggcttagctgagcagatgttatcactggccccaacttactttgagcaagggtggctgacccaaaaccatgaggtggcagtcagctggatgacagatgaacacttcccccataactatttagggtagtacccaagcactacaggaaagggtggcaggaactgcctcactcctaggaactggtagatggtgaggttgagggtgtccagcgcccttaggtcattttctcactgcctgggaacctcaccaaaatacttcttgcttccttggggtcagcccaaagctgtcacaaaatcagatatttccctttattccagatttcctggacactttcacccaattataaacaccccacttcagccccaatcacgtgggaggaagtgtaacttcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggctgggtgtggaggcaagtggatcacaggaggtcaggagtttgagaccaacctggccaacatgatgaaaccccatctctaccaaaaaaaatacaaatcagctgggcgtcgtggtgtgcctgtagtcccaacgcaggaggttgaggggagaattgcttgaacccaggaggtggtggttgcagtgagattgagcaactgcaatccagcctgggcgacggagtgagactgtctcaaaaaaaaaaaaaaaaggatcgtctcaacctttgccctcctactgcaacattttggtatttgaaatgaagggaccttccatacttatgctgttaatactttcattctcactagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtttctttttgattagtgtgattagaactgaacaacggcacttaaggaatctggaagatagcctggatagatttctgattcatcccaagacctcaaagacaacacctgggtaccaaatttctttatttgaaggaatggtacaaatcaaagaacttaagtggatgttttggtacaacttatagaaaaggtaaaggaaaccccaacatgcatgcactgccttggtgaccagggaagtcaccccacggctatggggaaattagcccgaggcttagctttcattatcactgtctcccagggtgtgcttgtcaaagagatattccgccaagccagattcgggcgctcccatcttgcgcaagttggtcacgtggtcacccaattctttgatggctttcacctgctcattcaggtaatgtgtctcaatgaagtcacacaactgcaaaacaatggggaagacagttagtgggcagctttcccaatccctaaggcaaatgatttcctccatttatttcctggggttccaatactcacatgggggtcatttttgtcagtggccagtttgtgcagttccagtagtgactgattcacatttttttccaaatgtaatgcacactccattgcattcagcccgctctcccagtcatcacagtctggtttctgaatgagaataggttaatgcatctctaccaactaacctagaagtcagcaagcccatcatctctaaccaccacgttttggcaaaagggacattactatttgcctaatttagtttagatggtaagcctaaaaaagcacaaaaggcaaaagcccagtgtatcatcactttataagggcaattgctagtttaagtgatttctgatacccgaacactgccagatgatgaagtatgacacccctaggatcttttgttcaccttgatatcctgaaggaagattcggccacctcgttggttctgcagcttcatcagtttctcagcatgttccctctcctcatgagattggtgaagaaagtatttggcaaagttcttcaaagccacatcatcgcggtcaaagtagtaaga

SEQ ID NO: 111388 - DNA, 1829 bp, Homo sapiens
  Payload ID: 1812
  Gene Symbol: BEST1
  Gene Name: bestrophin 1
  ENST ID: ENST00000534553
  CDS Start-End: 577-744
tcaggggtcagaacactggtggagcagatcctttagcctctggattttagggccatggtagagggggtgttgccctaaattccagccctggtctcagcccaacaccctccaagaagaaattagaggggccatggccaggctgtgctagccgttgcttctgagcagattacaagaagggactaagacaaggactcctttgtggaggtcctggcttagggagtcaagtgacggcggctcagcactcacgtgggcagtgccagcctctaagagtgggcaggggcactggccacagagtcccagggagtcccaccagcctagtcgccagaccttctgtgggatcatcggacccacctggaaccccacctgctggccctcacggaagaacaacagctgatgtttgagaaactgactctgtattgcgacagctacatccagctcatccccatttccttcgtgctggggaaaggtgcggactgcagccagtgaaactgaagttagacgttaggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacaggtctgtcctccacctgaaccaggggcactgcattgccctgtgccccaccccagcttcccttgctctgagcctacccttcctccacaatttcctagggttccatcactgccagagcacactggacctacgcccagcactggcttggggtatatacttggccaccttcacagggatcctagggaagtgttcgggaccttttctcacttcaccctggtatcacccggaagacttcttgggaccaggtgaaggaagatgaggttgtgctgaccagaatgctgctggagaactgccccagggctgacaggccaggcttagctgagcagatgttatcactggccccaacttactttgagcaagggtggctgacccaaaaccatgaggtggcagtcagctggatgacagatgaacacttcccccataactatttagggtagtacccaagcactacagg

SEQ ID NO: 111389 - DNA, 2404 bp, Homo sapiens
  Payload ID: 1812
  Gene Symbol: BEST1
  Gene Name: bestrophin 1
  ENST ID: ENST00000524926
  CDS Start-End: 105-1412
cagggagtcccaccagcctagtcgccagaccttctgtgggatcatcggacccacctggaaccccacctgacccaagcccacctgctgcagcccactgcctggccatgaccatcacttacacaagccaagtggctaatgcccgcttaggctccttctcccgcctgctgctgtgctggcggggcagcatctacaagctgctatatggcgagttcttaatcttcctgctctgctactacatcatccgctttatttataggctggccctcacggaagaacaacagctgatgtttgagaaactgactctgtattgcgacagctacatccagctcatccccatttccttcgtgctgggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtgggcctctccagggccctgctgggctggaggcatggccagaggggtcatggccagcagctgcctgagacgaggatgcagtgtcaggaaaggaaggtctcacgggtagaaagcagccaggcgtggtggcgcacacctgtaatcccagctactcgggaggctgaggcaggagaatcgcttgaacccgggaggcggaggttgtggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggcaaactcaaggaccaaactactgtggcccaagagggaatcccttctccacgagggcctgcccaaaaaccacaaggcagccaaacagaacgttaggggccaggaagacaacaaggcctggaagcttaaggctgtggacgccttcaagtctgccccactgtatcagaggccaggctactacagtgccccacagacgcccctcagccccactcccatgttcttccccctagaaccatcagcgccgtcaaagcttcacagtgtcacaggcatagacaccaaagacaaaagcttaaagactgtgagttctggggccaagaaaagttttgaattgctctcagagagcgatggggccttgatggagcacccagaagtatctcaagtgaggaggaaaactgtggagtttaacctgacggatatgccagagatccccgaaaatcacctcaaagaacctttggaacaatcaccaaccaacatacacactacactcaaagatcacatggatccttattgggccttggaaaacagggatgaagcacattcctaacctgcttcctaatggggatgcttcgccagccaggtcctcacctgtgtgtacaccagcaggacactgatccagtcacagccatacagctgtccacactgaagaacatgtcctacaacagcctgaatcaaatggttagcttaatagataaaaatcccagactacttcagcctttaatgccttttattcataaaaactgtgaaagctagactgaaccattggaaacatttaactcagactctggattcagagtcgggaacccttagttctatctgaatccaagacagccacaccttagtatactgcccaaactaatgagtttaataaatacaaatactcgtt

SEQ ID NO: 111390 - DNA, 1263 bp, Homo sapiens
  Payload ID: 1812
  Gene Symbol: BEST1
  Gene Name: bestrophin 1
  ENST ID: ENST00000526988
  CDS Start-End: 162-1151
attgcgacagctacatccagctcatccccatttccttcgtgctggggaaaggtgcggactgcagccagtgaaactgaagttagacgttaggcttctacgtgacgctggtcgtgacccgctggtggaaccagtacgagaacctgccgtggcccgaccgcctcatgagcctggtgtcgggcttcgtcgaaggcaaggacgagcaaggccggctgctgcggcgcacgctcatccgctacgccaacctgggcaacgtgctcatcctgcgcagcgtcagcaccgcagtctacaagcgcttccccagcgcccagcacctggtgcaagcaggctttatgactccggcagaacacaagcagttggagaaactgagcctaccacacaacatgttctgggtgccctgggtgtggtttgccaacctgtcaatgaaggcgtggcttggaggtcgaatccgggaccctatcctgctccagagcctgctgaacgagatgaacaccttgcgtactcagtgtggacacctgtatgcctacgactggattagtatcccactggtgtatacacaggtggtgactgtggcggtgtacagcttcttcctgacttgtctagttgggcggcagtttctgaacccagccaaggcctaccctggccatgagctggacctcgttgtgcccgtcttcacgttcctgcagttcttcttctatgttggctggctgaaggtgggcctctccagggccctgctgggctggaggcatggccagaggggtcatggccagcagctgcctgagacgaggatgcagtgtcaggaaaggaaggtctcacgggtagaaagcagccaggcgtggtggcgcacacctgtaatcccagctactcgggaggctgaggcaggagaatcgcttgaacccgggaggcggaggttgtggtggcagagcagctcatcaacccctttggagaggatgatgatgattttgagaccaactggattgtcgacaggaatttgcaggtgtccctgttggctgtggatgagatgcaccaggacctgcctcggatggagccggacatgtactggaataagcccgagccacagcccccctacacagctgcttccgcccagttccgtcgagcctcctttatgggctccaccttcaacatcagcctgaacaaagaggagatggagttccagcccaatcaggaggacgaggaggatgctcacgctggcatcattggccgcttcctaggcctgcagtcccatgatcaccatcctcccagggc

SEQ ID NO: 111391 - DNA, 1908 bp, Homo sapiens
  Payload ID: 1813
  Gene Symbol: BEST2
  Gene Name: bestrophin 2
  Uniprot ID: Q8NFU1
  ENST ID: ENST00000042931
  CDS Start-End: 1-1530
atgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactc

SEQ ID NO: 111392 - DNA, 2000 bp, Homo sapiens
  Payload ID: 1813
  Gene Symbol: BEST2
  Gene Name: bestrophin 2
  Uniprot ID: Q8NFU1
  ENST ID: ENST00000553030
  CDS Start-End: 90-1619
gtccctgtgggtccttgcaccggccaccttcaacacagcccccacccgggccacccactctcccttggccacacctgccgggtgccacgatgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaagcatttggtatacagtaggtgctcaataaattgctagtgatttttactcaaa

SEQ ID NO: 111393 - DNA, 2183 bp, Homo sapiens
  Payload ID: 1813
  Gene Symbol: BEST2
  Gene Name: bestrophin 2
  Uniprot ID: Q8NFU1
  ENST ID: ENST00000549706
  CDS Start-End: 325-1854
ctgaagctacagcctagccgagggaggaggaccaggaaagggaggcacgcccactccccagccccacccaacgccaaagccacccgcccattccatccctgtccctgtgggtccttgcaccggccaccttcaacacaggtgagatgagcccaggcttggggaaatagggggccctgagggaagagggaacctgcgggcaggaatgcatccggagtcctcccggggcggggagtggagggcttggaaggctggaggggaacggagagaggaaagcccccacccgggccacccactctcccttggccacacctgccgggtgccacgatgaccgtcacctacacagcccgagtggcgaacgcccgcttcggtggcttctcccagctgctgctactgtggcgtgggagcatctacaaactcctgtggcgagagctgctctgcttccttgggttctacatggcgctgagtgctgcctaccgctttgtgctgaccgaagggcagaagcgctacttcgagaagcttgtgatttattgtgaccagtatgccagcctcatccctgtctccttcgtgcttggcttttatgtgacgctggtggtgaaccgctggtggagccagtacctatgcatgccgctgcccgacgcgctcatgtgcgtggtggcgggcaccgtgcacggacgcgacgaccgcggccgcctctaccggcgcacactcatgcgctacgcagggctctcggccgtgctcatcctgcgctccgtcagcaccgcggtgttcaagcgcttccccaccatagaccacgtggtggaggctgggtttatgacccgcgaggagcgcaagaagtttgaaaacctgaactcatcctacaacaagtactgggtgccctgcgtctggttctccaacctggcggcacaggcccgacgcgagggccgcatccgcgacaacagcgcccttaagctgctgctcgaggagctgaatgtttttcggggcaaatgtggaatgctctttcactatgactggattagcgtacccctcgtgtacacgcaggtggtgaccatcgcactgtacagctacttcctggcttgcctcattggtcgccagttcctggacccggctcagggttacaaagaccacgacctagacctgtgtgtgcccatcttcaccctcttgcagttcttcttctacgccggctggctcaaggtagctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgctggccaaagaagacatgcagttccagcggctggacggcttggatggaccgatgggagaggcgcccggcgacttcctgcagcgcctcctgccggcgggcgcgggcatggtcgcgggaggcccgctgggccggcgcctgtcctttctactccgcaagaacagctgcgtgtcggaggcgtctactggggccagctgctcatgcgcggttgtccccgaaggcgcggccccggagtgcagctgcggggacccgctgctcgaccccggcctgccggagcccgaggccccgccccctgcgggtcccgaaccgcttaccctcatccctgggcctgtcgagcccttcagcatcgtgaccatgcccgggccccggggtccggcgccaccctggctgcccagccctattggcgaggaggaggagaatctggcctgagatcttagagcccagccccctaaggacagggaaccaggtccctgcacggcacccacgcaggtgtcccggtctgcataagcctcgtgtgcctttgtaaagtccacctacacttttgaccagctctcgctgcccgcatgtgtttggcgctgtgctaggggcgggagttcttccagactcttggaccagcccgccctgaccaccagctctacttcccaacccccactgcctgagaggtctctatcagtgtcctgcctgaattctttccttcaagtgaagatgtgactgactacctcctcgagttgtcatgaggatgaaagaatggcattaaa

SEQ ID NO: 111394 - DNA, 643 bp, Homo sapiens
  Payload ID: 1813
  Gene Symbol: BEST2
  Gene Name: bestrophin 2
  ENST ID: ENST00000552539
  CDS Start-End: 1-236
ctgagcagctcatcaaccccttcggagaggacgatgatgactttgagaccaactttctgatcgatagaaacttccaggtgtccatgctggcagtggacgagatgtatgatgacctggctgtgctggagaaggacttgtactgggatgcagccgaggctcgcgccccatacacagcggctactgtcttccagctgcggcagccttccttccagggctccacctttgacatcacgtgagccagttgggtgggcagggccgcctggggcagggcttatggctctgcggggcacatctgattgaaaaggttaagtggaatcaattctggagatggggataagagctaaagtctcaggactgtgataacgccagaagctaagataggagtcaggggacaaggtcaaggtctgagactgggccactgactggggacagagctaagggctgaggtcagcgaggatcagaccggtcagtggtgattccaaaggagatgagggctgaggccaggagcactggctcacgcctgtaatcccagtactttgggaggctgaggcaggaggatcctttgagcaagcccaggagttcagaccagcctgggcaacatagtgagacccccgtctctactaaaaataaaaaattagccaag

SEQ ID NO: 111395 - DNA, 1876 bp, Homo sapiens
  Payload ID: 1814
  Gene Symbol: BEST3
  Gene Name: bestrophin 3
  Uniprot ID: Q8N1M1
  ENST ID: ENST00000266661
  CDS Start-End: 344-562
atcagcagctgttgcttctgtttgttcccagctataactgtcatcagtggctaaactggcataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaattaatcctttggctcgagggcaataaaattttgtcttaaagtagcagatcctgctccatcaaaccacaactcaattgggagtaaatgcaaacatgtatctatattgagagatagattttactctgattagaaagatgaaggagggatttggggataaacaatatgaaaattgctgagcagagctgagccagccagaagaaaaagcgatagcaagagaaactgtaggcagatgcaacggcaggataaaatagctatgccaggggtgtgatggggcctgaggagagcatggcatggagacagacacgtgcagggaaccaagtggtgggaggacaagcccactcagagtgttgccgaactgtagcaaatcagtaactataattagcacagcctcagcaatgacaataatgatcatattctgaaaaaaatattggtctctgcttaaaatggcttgaagtcctgatgagggtgacattccatttcataacaaatacttttggaatggacttgaccaacaacctagagattttctttcagttgaccgactttgatttccaaaggtggagttacttttgtgaacccccaaaatctgagacaggtctcagttaatttagaaagtttattttgccaaggttgaggatgtgcacccgtgacacagcctcaggtggtcctgatgacgtgtgcccaaagcggtcagaacagtttggttttatgcattgtaggaagacatgagacatcgatcaacatatgtaagataaacattggttcagtctggaaaagccagagatgactcaaagtggggagggggcttccgggtcataggtaggtaagagacaaatggttgcattcttctgggtttctgattagtctctccaaaggaggcaatcagatatgcatttatctcagtgaatggagcaatgactttaatagaatgggaggcatgtatgccgtaagcagttcccaacttgacttttccctttagcttagtgattttggggacccaagatattttcctttcacactttggataagtaagatgtgtgaccctgcaaggaataacaaaaattattctgcttatatattcttagaggatacattaatgtctcagtgattgtcattcatctttcacagcacccagcaaaatactcaataaatttgtgctaaaaacaaaa

SEQ ID NO: 111396 - DNA, 1506 bp, Homo sapiens
  Payload ID: 1814
  Gene Symbol: BEST3
  Gene Name: bestrophin 3
  Uniprot ID: Q8N1M1
  ENST ID: ENST00000331471
  CDS Start-End: 173-1369
gggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttatta

SEQ ID NO: 111397 - DNA, 3532 bp, Homo sapiens
  Payload ID: 1814
  Gene Symbol: BEST3
  Gene Name: bestrophin 3
  Uniprot ID: Q8N1M1
  ENST ID: ENST00000330891
  CDS Start-End: 228-2234
ataaacaggcctctacaagtggaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 111398 - DNA, 2878 bp, Homo sapiens
  Payload ID: 1814
  Gene Symbol: BEST3
  Gene Name: bestrophin 3
  Uniprot ID: Q8N1M1
  ENST ID: ENST00000488961
  CDS Start-End: 213-1580
cagagagggctgactcagagtctgcacatggggtctgcttccaagttcttccaactgggcatatgcctccgccactctctgactgtcctttgcctgtgccaaggtttctgggaagaacaggaagttcagggatggcggaaaatgtttggcagattccctgagtccaaagccggagcacctgctcctgcctgagggcagagaggactggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaacta

SEQ ID NO: 111399 - DNA, 1692 bp, Homo sapiens
  Payload ID: 1814
  Gene Symbol: BEST3
  Gene Name: bestrophin 3
  ENST ID: ENST00000476098
  CDS Start-End: 332-925
agtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggagatctcgcttcaaccctgttccctttgccgaatgtctcctaatccccatcagtgatggtttgtggcacttctcttccaaaggggcctctgaggctgaaaacctttccagacccaaagaaaaggaagactgaaagtggaatttcagtagttccagcaaataatgagaacgatttaggagccaggagatttgccttgttgcccgcaaagcacatcttagagaaggttgcctactccaggctagatttgcttctgcttctagctagccttctaagaccagacccacccacccagggctccttccaggccagagagctcatccctgccctcagtgtattctcagtttccatggataggaatctcttgttgtatgcatgtctcagccttcatgataccttctgcaggggcagagcttcatggacatccagcaatcatctcaattttcagaattaataagagctgttcttctgtgagtttgattttagataattaaatatgctttatccttttcctcactctcaccattgattaatgcaaagtacttgacgatttaacttgaaaagaaaagagaccagcaatactgatagaatcagagcatcattgtgataactctatttagactgcaaatgctccaaacactctatttcttatgtccattgagttgttgttaccccatggttaagataattttttgaaggtctcaaaatttttatcctgacctacttatttatcctaatcatcataattctgcagattactacataaatgttcatgttctttagcaaatattaaaacacatttctcttgtttctaaatacagaaacagaaatagggattgacaagatctcagagaaaattccttccccaaaagatcattgggaagattagatgagattgtaaa

SEQ ID NO: 111400 - DNA, 572 bp, Homo sapiens
  Payload ID: 1814
  Gene Symbol: BEST3
  Gene Name: bestrophin 3
  ENST ID: ENST00000548658
  CDS Start-End: 147-572
aaagaaaatctgactgtgcacgagcgaagggtgacaccgggcgtgcagcaccgacctgaaggcacctcttcgggggagcccgaaatttgaagattctctttcctgtcggagactacaaaccaaataaatagaaaaaactatccaagatgactgtcacttactccagtaaagtagcaaatgcaactttttttggatttcataggttactcctcaagtggagaggcagcatctacaaactactgtacagggaatttattgtttttgctgttctttatacagcaataagtttggtatacagattgttacttacaggagtccaaaaacgttactttgaaaaattatcaatttactgtgacagatatgctgaacaaattccagtaacctttgtgcttggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttgg

SEQ ID NO: 111401 - DNA, 720 bp, Homo sapiens
  Payload ID: 1814
  Gene Symbol: BEST3
  Gene Name: bestrophin 3
  ENST ID: ENST00000552295
  CDS Start-End: 237-720
aggcacaaatgacattttttttctggaaggcaaaatcagaagatatggataataatatatttttgtcctccaacctctaaaaaggctaaaattcagctaaaagcatcagtgtcaccaacgtgtctgctgtaagaaactgctttataatttcctgttattctacagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcaggtctctc

SEQ ID NO: 111402 - DNA, 721 bp, Homo sapiens
  Payload ID: 1814
  Gene Symbol: BEST3
  Gene Name: bestrophin 3
  Uniprot ID: Q8N1M1
  ENST ID: ENST00000551160
  CDS Start-End: 358-576
gaaaaacatttaacccctgttcttgtcacactctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagattgttacttacaggagtccaaaaacgttactttgaaaaattatcaatttactgtgacagatatgctgaacaaattccagtaacctttgtgcttgggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcagaaagaactggcatgaaacccattctgccttcaagttttgagatgcagagcttttagttcctctgctaatagagcctcgtttgaatactctgcttgaaaggcaaaagacatctgcctcaacttcaatcaaggaaaaatagagcaactgtacagcaggcagaatctctatgatgactggaattttgtctatcaatggatgtaa

SEQ ID NO: 111403 - DNA, 2929 bp, Homo sapiens
  Payload ID: 1814
  Gene Symbol: BEST3
  Gene Name: bestrophin 3
  Uniprot ID: Q8N1M1
  ENST ID: ENST00000553096
  CDS Start-End: 153-1841
ccgacctgaaggcacctcttcgggggagcccgaaatttgaagattctctttcctgtcggagactacaaaccaaataaatagggttttatgttactctggtagtgaaccgatggtggaaccagtttgtgaatttgccctggccagacaggctaatgttcctcatctctagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggttgtcactcttgctgtctataccttcttctttgcgtgcctgattggacgccagtttttggatcccaccaaaggctacgcagggcatgacttggatctttacattcccatcttcaccctcctacaattcttcttctatgcaggatggcttaaggtagcagagcagcttatcaacccttttggagaagatgatgatgattttgaaactaactggtgcattgacagaaatttgcaggtctctcttttagctgtggacgaaatgcacatgagcttacccaagatgaagaaggacatttactgggacgattctgctgctcgcccaccatacacattggcagctgctgactactgcataccctcatttctggggtcaacagtccagatggggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccaccatcagggagaccagccagacaagcactttacagagcctgaccccacagtccagtgtgagaacttcccccatcaaaatgccactggtacctgaggtattgatcacagcagccgaagcaccagtgcccacatcagggggctaccaccatgattccgctacctccatcttgagctctgagtttacaggggttcagccaagcaagactgagcagcagcagggccccatgggatccatcctgtctccctcagagaaggagacacctcctggaggccccagtccccagacagtttcagccagcgctgaggaaaatatattcaactgtgaagaagaccctggtgatacctttctaaaaaggtggagtcttccgggattcctggggtccagccacacttccctgggaaacctaagtccagaccccatgagctctcagccagctcttttaattgacacagaaacatcctcagagatcagtgggatcaacattgtggctggctctcgagtctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgg

SEQ ID NO: 111404 - DNA, 1187 bp, Homo sapiens
  Payload ID: 1814
  Gene Symbol: BEST3
  Gene Name: bestrophin 3
  ENST ID: ENST00000547208
  CDS Start-End: 210-641
tctgggtcctctcagtggccagagaacagaaagaaaatctgactgtgcacgagcgaagggtgacaccgggcgtgcagcaccgacctgaaggcacctcttcgggggagcccgaaatttgaagattctctttcctgtcggagactacaaaccaaataaatagcagtgttcacggaagcgacgagcacgggcgcctgcttagaaggacgctgatgcgctacgtcaatctcacctccctgctcatctttcgctcggtgagcactgctgtgtacaaaagatttcccacaatggaccacgtggttgaagcaggttttatgacaacagatgaaaggaaattattcaaccacctcaagtctcctcatctgaaatattgggttccattcatctggtttggaaatcttgcaactaaagcccggaatgaaggtagaatcagagacagtgttgatctgcaatcattgatgactgaaatgaatcgataccgctcttggtgcagcctcttattcggttatgactgggttgggattccgctggtttacacccaggtagcagagcagcttatcaacccttttggagaagatgatgatgattttgaaactaactggtgcattgacagaaatttgcagctgtggacgaaatgcacatgagcttacccaagatgaagaaggacatttactgggacgattctgctgctcgcccaccatacacattggcagctgctgactactgcataccctcatttctggggtcaacagtccagatggggaaacagatgcctaagaatgagtggaagatggaagatataaaaatcccactccctcagcctcaattccagtgtgctaagagtgatcctggtggttaaaggtacaacactcgaatctttcaaaacaacttggctcctaaacacaagccaacaatctcatctgctgctcaactgaaaaacattctccactttttagcatccaggcatgtggagttcctaagaaatgcactttattaatgcccaacatggtaccttcccaggagattttaatggtaattttcactctaccagtgttatgtgtgctgactttagggcccacccttcacatatggtattactcactcaagggtttaaactggggcattccagaagtaccagtttccatgatgaaaagtggaacagcagaagcgcttaaagcaattttactgaa

SEQ ID NO: 111405 - DNA, 2047 bp, Homo sapiens
  Payload ID: 1815
  Gene Symbol: BEST4
  Gene Name: bestrophin 4
  Uniprot ID: Q8NFU0
  ENST ID: ENST00000372207
  CDS Start-End: 1-1422
atgacggtttcatacactctcaaagtggcggaggcccgcttcggaggtttctctggcctgcttctccgctggaggggaagcatctacaagctcctctacaaggaattcctcctctttggggccttgtacgctgtgcttagcatcacctaccggctgctgctgacccaggagcagaggtacgtgtatgctcaggtggcccggtactgcaaccgctcagcagacctcattcccttgtcctttgtattgggtttctatgtgactctcgtggtgaaccgctggtggtcccagtacacaagcatcccgctgccagaccagctgatgtgcgtcatctcggctagcgtgcacggcgtggaccagcggggccgcctgctgcgccgcaccctcatccgctacgcgaacctggcgtccgtgctggtgctgcgctcggtcagcacccgcgtgcttaagcgcttccccaccatggagcacgtggtggacgcaggtttcatgtcccaggaagagaggaaaaagtttgagagcctgaaatccgacttcaacaagtactgggtcccctgcgtctggttcaccaacctggcggcccaggcccggagggacgggcgaatacgtgacgatatcgctctctgtctacttttggaagagctgaacaagtaccgagccaagtgcagcatgctattccactatgactggatcagcatccccctcgtctacacccaagtggtgaccatagccgtctactctttctttgccctctccctggttggccgccagtttgtggagccagaggcaggggctgccaaacctcagaagcttctgaagccaggccaggagccagccccagccctgggagacccggacatgtacgtgcctctcaccactctgctgcagttcttcttctatgctggctggctcaaggtggctgaacagatcatcaacccatttggtgaggatgatgacgactttgagacaaatcagctcatagaccgcaacttgcaggtgtccctgctatccgtggacgaaatgtaccagaaccttccccccgctgagaaggaccagtactgggatgaggaccagccgcagccaccctacactgtggccacggcggccgagtctctgcggccctcattcctgggctccaccttcaacctgcgcatgagcgacgaccctgagcagagcctgcaggtggaggcgtcccccggatctggtcggcccgcgcccgccgcgcagaccccgttgctcggccgcttcctgggcgtaggggcgccctccccggccatcagcctccggaacttcggccgcgtgcgaggcaccccccgccccccgcatctgctgcgcttccgggcggaggagggcggcgaccccgaggccgcagcccgcatcgaggaggaatcggcggagtccggggacgaggccctggagccctgaggtctcgcctgcccccgcccggtttcccccacccactgccctccttccctcccgtgcccggtcctgccagccagctctattagagcagcttttcctgtgtgccttgaaggccagagcatttagggacagaacttgaaagagaagatggcgaaaagggcctgagccagggctgggaatgtgtccactttggtgggagagaaggtcggttgcttgggggacgtgaagctagaaaaataaatgagcccaggcatagaggactagagcccaggtgcacggttagcttcacagcaacagggagctaggccattggttctcaaacttaaggaaggatcagcatcacggaaggtcttgtcaaaagagtgctgggcaccactcccagcatttctggcacgttagatttgggatggcgcccaataacttgcatttctaacaagttcccaggtgatgctgtgctgcttgtccaggaaacacaatttgagagtcatgtgaaacgtgcttgaaggggtataccttaccctggtaaccttactcaaaagaagggtcagtgtgtgctgggggacttttgccttgtttgtaatgttaaagtttttgtttacattgagaatatattcaagtttttgtttaa

SEQ ID NO: 111406 - DNA, 1504 bp, Homo sapiens
  Payload ID: 1816
  Gene Symbol: BET1
  Gene Name: Bet1 golgi vesicular membrane trafficking protein
  Uniprot ID: O15155
  ENST ID: ENST00000222547
  CDS Start-End: 160-516
cggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtgtta

SEQ ID NO: 111407 - DNA, 3586 bp, Homo sapiens
  Payload ID: 1816
  Gene Symbol: BET1
  Gene Name: Bet1 golgi vesicular membrane trafficking protein
  ENST ID: ENST00000357520
  CDS Start-End: 140-523
actgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctagtggatccttcaggttccagggatttcaccagtagcagtgaaagcctacttctgctaattttgactgttcctcagcatttgtccagaagcttaaaaagaaggaggcttactttcagtgccatctatcacagctgcagaattatatcatgacatgtcaaaataatgactctgaagccttccaaatcttccaagaaagaagaatccttattttagattagtaggaaatggctttctaccactctgaaaagtctcttcttggccaaacatcaaagtctggagccagagataaattaatgcagagaactcctagttgggcaatcagttccagactccacagaccccaggacacaaactctattcaagaatctgtttgtgatggttcagaagttttcaagcttgctttgggtacaaactgtatttccaacacttctagccctatatatacctgtcaatgatattatacttataaatacaaaagtccttattatggatgaagaaatagattaattaaaattgtatagattatatattagcatatgatattatacatcattataaaaacgaagaaataggacttgagctttttttcaattttgccactgttaaaatcacttgaatctttacctttgggaactagcattcacaaaatggtgaatactaactcttatcctgatttgctacaagaaactagtctagaatgagcagtgtaattattagcactacactctttctatgcttcacacactacagaatcttcatcttcaagtctgtaattcctcaaagtacatggatcaacatttaggcttctggaggccagcagtgaacgaggcagtgcaaaaatgaccataattcacagtcaaccagccaacatgtgtagctccgggcacatgttattatattcactggatgttaacaggatttctagttagattgagagatgagaaactctttaaaaagctcattctctttggtagaatgatttattttcctttggatagatactcagtaatgggattgctgggctaagtggtagttctgttttaaattagttgagaaatctccaagctgatttccacagtggcagaactaatttacattcctaccaactatgtataagtgttctcttttctctgcagccccgccagcatctgttattttttgactttttaataatagccattttgactgatgtgcaatctcgtggtatctcattgtggttttgctttgcatttgtctagtaattactgattatgagcattttttaaatatgtttcttggccgcttgaatggcttctttggagaagtgtctgttcacatcctttacccaccttttaatggggttgtttttttgcgtatcgatttaagttccttaaagattctggaagttacatgcactcatatgttcatcgcagtgctattcacaataacaaggacatggaatcaactggggtgcccttcaacagtggactggataaagaaaatgtggtacatatatgccatggaatatcacatagccataaaaaagaatgaaatcatatcctttgcagcaacatgcatgcagctggaggtcataatcctaatcgaattaatgcaggaacagaaaaccaaatactgtatgttcttacttataagtgggagctaaacattgagtgcacgtagatataaaaattggaacaacaggcactgtagaagggggaagggaggaaggaaggtatgggttgaaaaactagctattgggtactatgctcactacttgggtgagaaattcatatctcaaacctcagcatcatgcaatataaccatgtaaaaaatctgcacatgtaacccctgaatctaaaataaaagtggaaatcgtttttatttttgtattatttatttatttatttttatttttatttacttattttttgagatagagtctcgccctgccactgaggctggagtgcagtggcgcaatcttggctcactgcaacctctacctcctgagtttaagcgattctcctggctcagcctcctgagtagctgggactacaggcacacagcatcatgcctagctaatttttgtatttttagtagagacggggtttcactatgttggttgaaggctgaggctgacggatcacctgaggtcaggagtctgaaattgtttttaaaaagtatgttttgatataaagccttttttcaattttttttaaagtctaattcttgacagagcaacagaaacaaataaagtagaagcccaaaaggaaatttgtcattactaaaaccaaccaggctcaggtgacttttcttctccattcagacgggaacttaaatgaacaaaaatatctttaacaaattgaagacaacttaaagatcagtttatttattcattcaacaaatatttattaactggctgccacatatccatcattgttctaaattctgcagatatagtagtcaattaagatccttccctcagtgaagacttaactttgagtggagagaacaaaaaatggacaaataaaatatatagtatgtcaaatgataagtgctatgaaaaaaaatgactactagattcagcatgcatgtatactgacttgctctttaaattttaagagttttaggaaatgtctacagtattagttttcttctcatactgctataaagacatacctgagactgggtaatttataaagaaaagaggtttaaccagctcatggttcttggggctatgcagttttctgcttctacagaggcctcaggaaacttacaaccatggtggaatgcgaaatggaagtagacaggagagagtttcagttttagtcttaaaagaaaaaaaaatacatctctaactaaccccagtccttgtgttagcaacaactactccttttgactggttagggaatgagcatctgtgacatgggcttgatgaagtcatggccaatgttaactttaaataagtttgaaactattgttgatacaaaacaaataaattgcagaggattttttccaaacatcccataaatgcatagaattgaaagcaagtttcatttccaatagttaaagagtctaatgtatccacttttaattatagccaagatgtttaccatcttatttgatgttctgtgctgtgaactgttgggaatctattagctcagtattttgaatttcagataatgtatcctgtgttttttttttaataaaggtttatctgaccattaaattacaaaa

SEQ ID NO: 111408 - DNA, 1031 bp, Homo sapiens
  Payload ID: 1816
  Gene Symbol: BET1
  Gene Name: Bet1 golgi vesicular membrane trafficking protein
  Uniprot ID: O15155
  ENST ID: ENST00000433727
  CDS Start-End: 146-397
gactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaata

SEQ ID NO: 111409 - DNA, 1357 bp, Homo sapiens
  Payload ID: 1816
  Gene Symbol: BET1
  Gene Name: Bet1 golgi vesicular membrane trafficking protein
  ENST ID: ENST00000457139
  CDS Start-End: 1-400
gctcccgtccttctgtattaaccacttttcccttcctcttcacagccacgctttttcaatgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatt

SEQ ID NO: 111410 - DNA, 601 bp, Homo sapiens
  Payload ID: 1816
  Gene Symbol: BET1
  Gene Name: Bet1 golgi vesicular membrane trafficking protein
  ENST ID: ENST00000425626
  CDS Start-End: 167-463
catcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggtaagtggttatgattttaactttaagaaatttgatctaatattcgcaaataatagaatttcaacttttattcattttgaaatacagagatcgtaagtccttgattcccgtccatttgtatctaatgtgtttggaataactataaggtttattttgccatgcttttgcatttttcatctcgtcttacgcatgtaagtgggaggaacaagtggaagccaatatatctttaatcct

SEQ ID NO: 111411 - DNA, 533 bp, Homo sapiens
  Payload ID: 1817
  Gene Symbol: BET1L
  Gene Name: Bet1 golgi vesicular membrane trafficking protein-like
  ENST ID: ENST00000332865
  CDS Start-End: 36-212
tcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatgggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaag

SEQ ID NO: 111412 - DNA, 2916 bp, Homo sapiens
  Payload ID: 1817
  Gene Symbol: BET1L
  Gene Name: Bet1 golgi vesicular membrane trafficking protein-like
  ENST ID: ENST00000325147
  CDS Start-End: 62-370
ccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggtaagggcccacggtgtgcgtgtatcagtgccctgccctagcactacctgctgcagagcctgcagtgtctccttcagcactggtgcgggtgggtggtcaaatcaccacttctgtgtgatcttgctgggattcctcccttaggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaactaa

SEQ ID NO: 111413 - DNA, 2819 bp, Homo sapiens
  Payload ID: 1817
  Gene Symbol: BET1L
  Gene Name: Bet1 golgi vesicular membrane trafficking protein-like
  Uniprot ID: Q9NYM9
  ENST ID: ENST00000382762
  CDS Start-End: 108-443
atcgctagctgggggcggggccggaagctctttccccgcgactgcgccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagcccctcccccctcccccaggtgctagagagccaggcagagctggggccacagcgtgtctggagaagccaggtctgagcagagcagctggtgaatcccagacgtggccacctgtggcttgcagcccttctccccgcgcttgggactctgacatcttaaggctgcacggtcgtgtccttgtctgggtgaggccatgtctgtgatccaaggttcctggaactgacacaggaaggggctgtgaaccctaagtgggtgtcatctcctccgaccgaggcttctcaccctggagatggcagttactcctggccatggttgctgagcatgggcagaccagtggaggccaccctactgtgttatctgcgccttcgatgaagtgagacccttggggagaacgggctgtggatgaaggagtggactgcagccttggcctagccactgggctgggatcttctgggtcatgtgactgtgtatccaggagcagaaacttgtattctcaggattcaggatctacccagcaccaaagatgtattttcaggagaacagacctagaaatgggcctgtctggcatttcagagtcaggcaaagcaggcagggccagggagcttctgtgggtctacacaagaaggttcctgtgagggctatcagttgttgccttctagcttgctggtaactttggcgcctccgccaagccctgccagactcccctggctgtgatggcattctgtgccatcctccttgtccccagcctctgcaggatgccctccctacccacctctccctgggccttccctgtccactgggctggattcatgttcaaaccactggactggcagggcaacgacttcttcccacctcaagatgaggtcctcgcccccttgtcttggcataaaaacacctttaaagcatgagccatgtgcttctttgcccttctctgtcctgttccaatcttctgcctcccagtcactccctggggactatgggatcactgtccccccacctgtgtggccacaccatatgtcctgtcaatccagaactgcctctgagctccaggctgaccacagatcagccacagcctgatgcctgcagccccactttgctcacccttcccctcccctcctccttccttccacacagcaagcctacctttctccatccatgctcaccatagcccccttccttgtgacctggaccctccattgtacctggctgagactgtcagcctcctggaggagtggggtccaccttcttcttgccctatgcagtgcaagctcacttctcacccagcaaggttgactcatctgcctccatgtctctggggctttgctgttgccctgaaacctagctgggctggtcttgctcccagcttgcttccccctcctcggatgtccctttgcaggcccctgtcgttcctccggcaccagtgtccttggctgccatggcaagctcatcaggggcttgtaccctggtcaccaagcatggtagcagctgcctgcattgtatctccatctggtcactgcaggtgccaacccttcatcccccatgttttcctgggccatggagggctgacctccgtttctggggaatgtggctgagctgtggtaaccagctacaccccaggtgctctttccatggtggtgcctgctcatcttgctgatgcaaactaggaagttaggctgcatctcggagtggctttcgctggagaggtgctttgctgtctctcagactcagtcactgtgttccctccccgcctctcttatctccatggctgtttgcagctctcccaggtactttggggtctgagctggaattcctttgtggtttgctcttctgcttctcactcttgtattaagaaggattccacaaagggagagtggcatccctgctgctgctgtgccagaccagagtttcctgaggggccctgaccctaaccctccagctcagccctgtacacctgaccctgtaaatgagtggggtttgctgactgtaatccctgacaccagtaaaaccaaaaggactcttgggggctcagtgtgagagccagggttacctactctgccaagtgaggacaaactgctaggctgtatcccataatttcaggatgagaaacattaacaataaaaatttgtagtaaacataacctcatgaagaact

SEQ ID NO: 111414 - DNA, 637 bp, Homo sapiens
  Payload ID: 1817
  Gene Symbol: BET1L
  Gene Name: Bet1 golgi vesicular membrane trafficking protein-like
  ENST ID: ENST00000410108
  CDS Start-End: 63-521
gccacgtctgaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggtatttcaggacagccaggagggggcgcacatccgccgagaaactgtgagcaagagcgtctgtgctgaaccatggcgccaccagagggcgcgcgatcccgccccaaccaacttcccgctgaagtgccagaagcagcgaggagcttcaacttcctcagggcagcacgggggtcgtgttaatttggtgttcttcattgatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcgtgccaggtgcatctgtggacaggggccatgctcctgggc

SEQ ID NO: 111415 - DNA, 665 bp, Homo sapiens
  Payload ID: 1817
  Gene Symbol: BET1L
  Gene Name: Bet1 golgi vesicular membrane trafficking protein-like
  ENST ID: ENST00000486280
  CDS Start-End: 266-532
ctctggcccagctggggtgacctcggccgagaggaccctgtcaggggggcggattcggatccttccgggtccgagcagggccgggtttcggccggcactgccgttaggaccgaaggcgcgcgtggcggcccagcagctccagcgaggggtcgcgcagcagcggggtctccccactccccgccgccccctgtgagatcgttctgcatgggttcgggctcagagcccgggcgctgtggaagagattctagaccgggagaacaagcgaatggctgacagcctggcctccaaagtcaccaggctcaaatcgctcgccctggacatcgatagggatgcagaggatcagaaccggtacctggatggcatggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctg

SEQ ID NO: 111416 - DNA, 560 bp, Homo sapiens
  Payload ID: 1817
  Gene Symbol: BET1L
  Gene Name: Bet1 golgi vesicular membrane trafficking protein-like
  ENST ID: ENST00000529614
  CDS Start-End: 54-332
gaggcggctgtggccgcgtcggtgtccgcgtcgaggagccggggcagggcacgatggcggactgggctcgggctcagagcccgggcgctgtggaagagattctagaccgggagaacaagcgaatggctgacagcctggcctccaaagtcaccaggctcaaatcggactcggatttcacaagcatgaccagcctgcttacagggagcgtgaagcgcttttccacaatggcaaggtccggacaagacaaccggaagcttctatgtggcatggccgtgggtctaattgtggccttcttcatcctctcctacttcttgtccagggcaaggacgtgagccagtgggagctggtgtctgtgggtgccaagggcagccagggtcttccctgcctggtgttttgggctccagaggacttacctacaaaatactcctttgcaatgataattgtgggtcaggaatcttcttcctgtgtggcaggaggctgcggctgcctgtgacctgatgagctcatgttggctggtcccatgtgtgaaagggactctctcggggaaaccaaggcccagc

SEQ ID NO: 111417 - DNA, 4254 bp, Homo sapiens
  Payload ID: 1818
  Gene Symbol: B3GLCT
  Gene Name: beta 3-glucosyltransferase
  Uniprot ID: Q6Y288
  ENST ID: ENST00000343307
  CDS Start-End: 150-1646
cgatggcgcggcggagacggagggaggaggggagccggcagagaagggtcagccgcggcggcagggcggcggcggcagcggcgcagctccgctccccgcgcgtctcccttccccgcgcccaggtagggcgctcagcctccgccgccaggatgcggccgcccgcctgctggtggctgctcgcgccgccggcgctgctcgcgctcctcacctgctccctggcttttggtttggcttctgaagatacaaagaaagaggtcaagcagtctcaggatttggagaaaagtggtatatcaaggaaaaatgacatagacttaaaaggaattgtattcgtcatccagagtcaaagtaattcttttcatgcaaagagagcagagcagttaaaaaaaagcatcttaaagcaggctgcagatcttacacaggagctccccagtgtcctcctccttcatcagctggctaaacaagaaggtgcatggaccatacttccgttgttaccgcatttttctgtaacatatagcagaaattcatcttggattttcttctgtgaagaagagacaagaatacagattccaaaactcttggaaaccctcagaagatatgacccctctaaggaatggtttttgggaaaagcattacatgatgaagaagctacaataattcaccattatgccttttccgagaatcctacagtttttaagtatccagactttgctgcaggctgggccttaagtattccacttgtaaacaagcttaccaagagactaaagagtgaatccttgaaatccgactttacaatagatttaaaacatgagattgccctctacatctgggacaaaggcggaggacctcccctgaccccagtgcctgagttttgtaccaatgacgtggacttctactgtgctaccacattccattcttttctaccgctttgtagaaagccagtgaagaagaaggatatttttgttgcagtaaaaacatgcaagaaatttcatggtgacagaatacctattgttaagcagacttgggagagccaggcaagtctcattgaatactatagtgactatactgaaaattccattcctactgtggatttgggaattcctaatacagatagaggtcattgtggaaagacatttgccattttggaaagatttctgaatcgtagccaggacaaaacagcatggttagtcattgtggatgatgatacattaataagtatctccaggctccagcacttgcttagctgttatgactccggcgagcctgtgtttctgggagagcgctacggctacggcctgggcactggtggctacagctacatcacgggaggaggaggaatggtcttcagcagagaagccgtcaggagacttctcgccagtaaatgtcgatgctacagcaatgatgctcccgatgatatggtcctgggaatgtgctttagtggcttgggaatccctgtgacacacagccctctcttccatcaggctcggccggtggattaccctaaggactacctttctcatcaagttcccatatcgttccacaaacactggaacatcgatccagtgaaggtgtatttcacatggttggcacccagtgacgaagacaaagccaggcaggagacacagaaaggttttcgagaggagttataaatcagggtgacctgtgcgcctagcctgcgcagggaatgaactggagactgtggcctcatcccactgtgctgtgctcacaacacttgtgtctgccacatggcattgggtgcttcctgactttagggggagattttatgtatggtattttttgacagaggaagaaaaggggtcacaggagaaacatttttttttctgggaaaaatcacttgcttttgacttatgcagttgttttaacacttagtgatgactgtgtattctccaagctgtgatacagcagtttttttttattgtcacagggaaataaatggtaccagaagtccctttcctgttctgtctcttcattgtaatggaagtttcagttgggcatgagcctggagagatgtgactgtctacagttctatttgtatatataaaaagaagactgaaagtcttttgacatggatattgtgaatggtatgaacttttaaaccatattattgatgatgaaaattatttcctgggaactcagtaggaataataccgtattaaggaataatactgtacataaaacatcatgaaaccctagatatgaaatcccctgaagtctgtaatcatggtggttatgttttgtctattcttttgctgtttgtgcctcataaaaagagaatgaggtcttctgctagagcttcgtattgctttggaagttcatctgtgttttatttctccctgaagccctatctttatggcttacttgtaacatgaaagtagtagatgctgccagaaaatagtgtcctcaatattttaaaacaatgttgacatgttttgttcaagtcagcaagctctatgtgagtctcaggaagtgaattaaatttggaccttatgttttactcttgttttttttttttttttaaatgttacttaatgactctctcctgactcaggagagaaaccccttgtggaaggacagcatggtgatcaggcaatttctctgggttcccaaagaatgacatttgaacacagtattttgaaacagctctagttttcaaattatatctttaatatatagtaatgtaacatattcagtattaatgtataaaaagcactctaattatataattcagtttttgtaaaggtatttgcataaaatttaatatgtcttaaactaattttggtaaattacttcttttttttctttttaataaaaactgttactcattaactttgcttataatgctttttatagcccagcacagaatttaaagccataccaccaaaagtacctgtgtgtgttaatatgtttttcttgtagcatagattgactatttgcaatagtattagtatttaccatttttccaaattagcaactaccagacctcacgtgttgcagtgataacacaatgcattggattcagttttgtgaaaatggattctgtggccatccaagggatgtatcagggatgatcagctgatgagaggctccagaaggatttctagatcgcttcaagcctatactgatggccttagctttgttcagtcattgtaactgggattgttgtcattgctaccgtggtagtcaccttcatgtcatctataatagtactcctggagagccctggctgcctacaccagtggaaaagagtctccagttctgctctggcctactaactgttaccactgagagaacaacatgttcatttgacatgattgaagctggcatccgtatatgaagatccttgtcaagctttcttctgtggtctgattagtgccttctactgataccggggcacctcctctggtacttttaagtgttttgttaattatatttactttttggaatggtgtaagcctaaccacaagtaaaagatctttgcctaagtttttgatttctcaaatattgtgttcattagtctagactgggaatggggaggggaaatggggaaaatgaatgaatgaaatcagaaaaaagtcagcggctcagtaaatacagtttaaagagagaataattacttcagagctacccttttaagagaaaaccatcagaaattgataatgtttatataaagtttataaagccattgtgttttgttatataacaaatcagagatgttattttagaatcgattcccatctaaagaactcaattttgagtctgacatttccaggaccagatattgtcttactcacatttcctttgctttgaaatagggctttccttccaaatggctatttttaggctagggatgttaacatcagggatttgtgtgtggaataactggaatgtcatttttgcttttaagccatttctgatgatatagccaaagcaggttgtctgactatgtaggatttttacatcttgaaactaaatcagaaatccagacatgaaaataacctttctagaatgcctaggagcagaaaacaataatagcatgctaaatcacaaatgatgctatgtatgggtatgtaaatatcagtgctgtctgcatttctgggtttattgaagacctcttgttgtatatatcctcaaaaattaatgtaattgacatcttcaagaatgtttctattgtcttccattcataatcagagatgtaatttgtatggactaaataaaaactttattatgtaatgaaaa

SEQ ID NO: 111418 - DNA, 3652 bp, Homo sapiens
  Payload ID: 1819
  Gene Symbol: B3GAT1
  Gene Name: beta-1,3-glucuronyltransferase 1
  Uniprot ID: Q9P2W7
  ENST ID: ENST00000312527
  CDS Start-End: 394-1398
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaagacctgctagccaacattcagctgctctgtcctctccatgcctggccggcccggcccatgcctgttcttttctcccctgtgctgccgccgcccgtggccgcccctctcctgaacttaccgccactcaggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtc

SEQ ID NO: 111419 - DNA, 3522 bp, Homo sapiens
  Payload ID: 1819
  Gene Symbol: B3GAT1
  Gene Name: beta-1,3-glucuronyltransferase 1
  Uniprot ID: Q9P2W7
  ENST ID: ENST00000392580
  CDS Start-End: 262-1266
ggagggagccgcacgcggcccagggcagcggtctaggggcgccggggccggggcgtaggggccgttgcccgcgatggaccgcaccggagacgctccggactcgtcgccgcaggtgtccaccccccagggttcctgacccctgcccctggacagcgaccccttctcagactccagttgggccggactctccaaacctgcttccgcaatgggtgggttgtgagtgctggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcaggagcctcctcctcagaccctgttcttggccttccatcctctccccacggctgatggtccctccaaggccgactcctaaggaatcaccatcaccctcctttctattctgggggcttctgagagagcccagcctgatgccagaacaaaggacagagaatttaagcacagaaatcccagacctgttgttctctccatccagcgtgaccagggcccgagagacctgatggccagggtggggtgtccagcaccagccaagctggtgctccagcgcacctccccagagctccccgcactgacggggctgcaggagcaggtgcagtgggcgcccacactggccctgcagtgatgcagggcgggagggagataagaagaccccgcagtcaagtggagcatggccctccctggctccctgtccctgggctcagcacgaccacacaggacacccagccagggaattctgaagaccagagagcagcccacgggcatcacgagcgctctgctcctctcctgggcccctgctcttcccgagagctgcccccaaatcagacatacctctgtggctctcctctggttcacgtttacagagcataaggctgtcttggatcccaacaggcacccagccctgcatggggggagcctgggcctaataggcaccccctgtacctcaggctgtggcgggagcagagtccccccctccggcccctcttcctttaccccttctcctccagcagtggcaaaggggtaggctctagagccagcacaggtcactgcctgacctggactaagaaccccacggccccactgtccacacactgcctccccaccgcccacctcggctgctaggcccctcgcctggactggactggggagggaaagcgccttttcctgcagctcttcagagccacagacctcagggtggagtgagcccatggtgggcagtgggcaaggcggtgggtggtgggcaaggtgggacctcctgcagcctggaaagaggagggaggccaaggccattccctaactccctcctgcccctggtctgaggaggagggactctggagtagcagaggggctgggaaagagggggcaggggctgctgggacactgagcaggagggaggcctgagcacactgctttggaaattattctaaacacaaaaaagggaaagaaaatgttatttctccctaagtcaggagcatgcagagctagcccacctcatgtccagctgtccactttccatcctggagaaagaacagtgtgcctcaaactcctgccctccccaggcctctggggcccactggaaagggctctgaccccctggcccagccgggctctctagtggtgatccggctcattctcctgcaagttggaagcacaattttccccccaagtggaggaaaaggaaagggccccagcctactgaagaggtgtttattttttaactaacagcctcccaccccattaagactcaccaggagaggtctgagggccattcagaacccactcctgagtgggtgggtgggtgggactcagtccagagacctaacattcagaatatagcattggttgcctattttgagatggatttaatctcccacagtattcatgagaccatctgatggaatcagatccctgagccaccttgcaggacgttttccccaacctcttacaccctggatgtcactttggaaaccaagcccttggaagcaagtggggtggcatgggagagaagggaggaggtgggcacaggtggtgagcttatgtgtgggcactctactgcctcacagaagccagccaagtgccaaggtcagcttggctggtctgaggccaccttcttagccaaaaacctagggttcattttcaggactttgataatgaacaacaaaatggggacttctttgggcagatgctaggtcagttgttttcacctaatatcctcttttagctgcatgtatatttatttataattataaccctggtggactgcagccttcatctttattgggaatgagtttgttataaatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgcatctggtctgttttaatttaactgtatttaatttgctttcaaaattaaaagtcaaatacagtttttaacagtcct

SEQ ID NO: 111420 - DNA, 5737 bp, Homo sapiens
  Payload ID: 1819
  Gene Symbol: B3GAT1
  Gene Name: beta-1,3-glucuronyltransferase 1
  Uniprot ID: Q9P2W7
  ENST ID: ENST00000524765
  CDS Start-End: 4546-5550
agaggtgttcccagtatggccgatctccataggcatactggcccttaagtcaggactcagttccacgggcccttaagtcaggactcagttccatgggtgctggcccttaagtcaggactcagttccacgggtgctggcccttaagtcaggactcagttccacggaggctgttttgttggcgctcttgcctcgcctctggccctaggtgcccactgagctacactttcctcacataggacatcccttcatcttcgcagagccctatggtaacctccagttgctaaaatggcaggatcgttgaaacttccagctcaacctccctattgtaaagacgaggtcaaggagggcaatcagcatgacccaggtccccgtggagcacctgccggacacgtccaggccgccaccctcccactcccatgtgctgccccagcttctgctccccatctgggaaccaccctccactctcccacagggaagtgcttgcttccctctgaggctctgagggcacccggggagggcagggcacagccttttgtgtctctacttgccgagacgcctgagatctgaggttggtcacagatatggtgcaagtgtcaggatgggagttgtgaccacggcaggcctgggccctacactcacacacactgcccacgccgcgtcctgcctctccacgaagtcccccttgtgcctccacccatctcctcctccagcaccccattcttccccgtgcttgcctccatctcctgggctctcctgggtgtggccaagccactcctgcacctttgtgctgattcttctgcctgacccaaggtcctagaagccattctggggtccttgttagagacagcctgcgaccacagacaaacaccgccctcctccaagccccaggcagaagcagcaggctgcgagaggggaccagtgctggccaaccttgcagccccgtctcagactggggcccagagctgggggcaggtgcagcccacccgctgcctggccccaagcccctgcccagcccaggcatcacatcccacgacctgccccctgccggccagctggcgttctccaggctgggggctctctgtgttctgcttgataactgcctggtaattagctccacgattttgctactatgcttataatagcctccattaaagttatggggttttcaagccataatggcttccagagtaattaatgcacaactgggtttattgctgagtttatttttagaggttttctccctctctccccctcccttttctctcatagatgttttgaccaaaaagactggatgggagcagaaggcaccccacggcacccttgcccacaggccccatcctcccctctcttcccttcccgcccctccttcctgcttcagcctccaagcaggtgctagggccctgcagtgggggcagccattgcagaggagggtggctgtggtccaggccagaggaagcatttggcctgtgtgtgccccttacccaccctgcgcctggcccaggttcgagaggcttggaggcctgggacctcttatcctatgcccccgatgacagcatagagccagatggcctggactcaattccagctccaccatttcctaatggttgacctcaggcaagttactccccttctctggcctcgatgaacccacagggaccacagccatgcctactgcacagggctgctgtgacgttgcaggagcaggtgcatgtgaagagctgagcctcatcttcggacatctctcatgctatagggaagtttgtataaacaacagtgcaagcgggggctgagaggctgccccaaaggaaaggcagtggcccacagggactgagctggcaggacactcatcttctctccttggctttctccatcctggtattagaacctgcaccaacaccaggagcacttgagaaagctccttcgagagtctctgagaacacagaagaaatcttcctggacatttctgaagccccagccaggcccagcctccccatccttcatcagatgtggcctaagatccaaacgtgtcttggccaaagaaccaaaacgtgtcttgacacgcagccccatgcagccccagcagtggcctgggtgtggagggacaggctaaatctgggggatgtggcatgaagtcacttgcatctcagaccacaagacccagcaggcatcccgtgtggggttctaggctctgtccctcactgggccagcaaagaggagtttacgggcggacacagacacacacggcctagaatgtccactaggggaactacgtgcctgtgacgttgaaccccagtgggtcttccactccccggggaatgggtgggggagactctctggatggagtgggcctctgatggcggggtgtgggcaggggatgccggccgtcctgggaaaccacagtgctccttaatggaggggatgccggccgtcccgggaaaccacagtgctccttaatggaagacaaatcctggtcttccacaggcgtcagaactatttggagagaggacccggtgaggagaggaaaacacgctattttggaaactcaggggctaaaaaccctcctcggccatagcactcgactctgcctgaaatggtgagcacacgtgagctggggcaggagcaggcagcatggcccccaggtgaggtactgtccgtatccaacactgggcactgggacgggtgggcacagtgaggctggctgggctgcccgaggctgcctgccctccccaccacccccacgggtccctgctgcatcatgcatggtgctcagcacagaagtgaaaagggaggagaagaggatgtgacagtttccaaggcggtcaggaggtctcttcgcccagtgtccttgccatgtgagagaacggttcccagagatgctaccagtggaccctctgcaggactgaggaatcccagtggctcattctcctcacttgggccccctgctgttctcattttggaggactgtctcccctcaatgtggcagcccctgcggggacccctcttcttgctgctgcccagcccagcacctggtgctctgtcctgcacagagcggtgctccacaaggatgtcctattgacacggaagaggaaggcactctcgtacttccccccagggaccatcccagaaacatctcttctttgtcctcaaaagactgtcaccaaaatgcaaattgaaaccacagtgagatactatctcacaccagtcagaatggctattactaaaaagccaaaaaatattagatgctgatgaggctgcagagaaaaggcaacacgtatactctgttggtgggaatgtaaattagttcagccactatggaaagcaatttggagatctctcaagaacttaaaacagagctgccattctagccagcagtcccattactgggtatgtatccaaaggaaaataaagtgtttcacaaaaaaaacacctgcacctgtatgttcatcgcagcactattcccaatagcaaaggcatggaatcaatctaggtgcccatcagtggtgaactgggtaaagaaaacatggtgcatatacagcaaggaatactacacagccataaaaaaggacaaaatcatggcctttgcagcagcctggatgcagctggaggccattatcctgagcaaattgacacaggaacagaaaaccaaacacgatgcattctcacttatgagtgagagctaaacactgggtactcatgactgtaaacatgagaagaatacacactgaggactctcaaaggaagaacggctgaaaaacgccctgttgggtactatgctcatacctgggcagcgggattcatcatactccagatctcagcatcacatgcaatatgacccataacaaacctgcacatgtgcccccaaatctaaaatgttgaaattatttttaatataataattcgtggtccatatatggttaaaaaaaagaaaaaagagagagagaaaataaaacctctcacccctttatccaggctttgataagtagctggcattttagggctgcacgggagttaccctgtttaattctgagaatgaccttatgaggtagggatccacagtgccccattttatagatgggaaaactgtggcatggagaacggaaatgacttggcaaaggtcttacagcctgtgggtggcacagttgggatttaaacctggtgtctctgcagtctgtgcttctgacccctgcaccctactgactttcataaatggagcagagccatggccctgtgcctgtgggaaggacagagcccattccactctaacaggcagacaaaagaggtcctcaggtgatggacagttgaggctccattgtggaacccccgatgctgtgtgtcccagagcagggcccagccttgctggcatccattcctatacctgggtctctggctatccgcttctgctctctcttgcaggtgtccaccccccagggttcctgacccctgcccctggacagcgaccccttctcagactccagttgggccggactctccaaacctgcttccgcaatgggtaatgaggagccgtgggtgcagccagccttggagatgccgaagagacgggacatcctagcgatcgtcctcatcgtgctgccctggactctgctcatcactgtctggcaccagagcaccctcgcacccctgctcgcggtacataaggatgagggcagtgacccccgacgcgaaacgccgcccggcgccgaccccagggagtactgcacgtctgaccgcgacatcgtggaggtggtgcgcaccgagtacgtgtacacgcggcccccgccatggtccgacacgctgcccaccatccacgtggtgacgcccacctacagccgcccggtgcagaaggccgagctgacgcgcatggccaacacgctgctgcacgtgcccaacctccactggctggtggtggaggatgcgccgcgccggacgccgctgaccgcgcgcctgctgcgcgacaccggcctcaactacacgcacctgcacgtggagacgccccgcaactacaagctgcgcggagacgcccgcgacccacgcatcccgcggggcaccatgcagcgcaacctggccctgcgctggctgcgcgagaccttcccgcgcaactccagccagcctggcgtggtctacttcgccgacgacgacaacacctacagcctggagctcttcgaagagatgcgcagcaccaggagggtgtccgtgtggcccgtcgccttcgtgggtggcctgcggtacgaggccccacgggtgaacggggcagggaaggtggtcggctggaagacggtgtttgacccccaccggccatttgcaatagacatggctggatttgccgtcaacctgcggctcattctgcagcgaagccaggcctacttcaagctgcgaggtgtgaagggaggctaccaggaaagcagcctccttcgagaacttgtcaccctcaacgacctggagcccaaggcagccaactgcaccaagatcctggtgtggcacacacggacagagaagccagtgctggtgaatgagggcaagaagggcttcactgacccctcggtggagatctgagcctcaggatgcagggcagatgtgggcaggagtggagggcgtcgtcaccacagtccccttcccactgggccacctgaaagtatccaggcattaactttcacccacgcagctgggtccttctgccaccagactcttcagagggtgtcaccttccaaacatcttgctgatttttctgctggcagtgacg

SEQ ID NO: 111421 - DNA, 6565 bp, Homo sapiens
  Payload ID: 1820
  Gene Symbol: B3GAT2
  Gene Name: beta-1,3-glucuronyltransferase 2
  Uniprot ID: Q9NPZ5
  ENST ID: ENST00000230053
  CDS Start-End: 610-1581
tgagaagacaagagcaagggactgagagcaggcttccgctgcggcgcgcgaacacagccgggacacaacccccagcgtctccacccgctcctcgccaccccggcgggaatgtgaggaaggaaagcccccagcgccgccgcccgccctcgaaggcgtcccagagagcgtcctgggggcccgcggctggagcccttgtgcccgcagcaccgccggactggagcggcgaggcgcaccgggtgccgcttctcggcttccactcttcagaaagagcgcggtggggatcagcgcctttcccgcactcggcacaactccgggaccggcggcgcgcggctggaccgagtcccgcttcccgccagctcacctggagtcgggggcagcccctgcccgcccgcctgcaccccttgtcgctctagcttgcgcgaacctgccgctcctccacgcccaggtagtgagccccgcggctccaggtctctgcagcgccctcggccccatggacagcgcacccatcaccactccctaagtgctggcgccgccgctgtccaagctgcgcactggggtccctcggctcgcccctctctggggtgtccgagaggccagggagcgtgcaccatgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctggtgagccgcttcctggcgcgggccgggctgcccagcactcacctgcacgtgcccacgccgcggcgctacaagcggcccgggctgccgcgcgccactgagcagcgcaacgcgggcctcgcctggctgcgccagaggcaccagcaccagcgcgcgcagcccggcgtgctcttcttcgctgacgacgacaacacctatagtctggagctcttccaggagatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaacaggtttttaaaacagacaagtattttgtcagctaaacgttcctgatgattcctgactttgcaatactaagtaatttttggaaggttagtggcagtatacatcataggaaataaaaacccacaaatgaaaaggtctatggagtcatgtttaatgtagggaaataacattttgtcaatactaggcaccataaaatgtaaacacaattactgtcataaacctagatataccttcaaggattgaagattgaaagtggctttgttttagttagttaccctgtttgcatatagtgcagaaaaaggtcttcatgttagcactatgtacattaagaagagatccaaattacaagagaggcagataaaatttgaattctttaagcattcattaaacgaagttttggagtaacatccacgtttatcttcctttcactaatcacgttccctgttaagcacatcataacaacagcacagtgaagtgaatgatgaaataagagcattttgatacactagaaaacagtgctcagtgagacatttacattctatttatatgattaaacatttgatcatacagtaccttcctacaggattactggctaattttggggtggggtttatactattagaggtattactaacatgataactacttcccttatatgcaaacattagagctataattttattgagaggaaaactgattttgcaagttgagcagcttctcaaataatgcagtacatgaaatcatgggaaatatgagcaaagctgcccttgacataaaatgatttatcaacctgcttttcaccacatcaaattgaatcagtacagaccaacacggtcaatcagatcattcttaatatgaacaaatgggtaaaaagaaaaaaaatatgcatatgaataaacaggggaactagatgcgtttcagcaaggaatgtcaggtggtagttctggatgaaacttgtattgcagttttcatttccacagttgtgtgctgagagtctgacctgatgagcttccagaccatcctgctgttgtgctggagggctggccaaaacctgcagtaggggttgcactactgatactcatgccagccatctgctgattcatctgtgaaacatataaaaggcttagttcaagaggcttacttcacttttaattcttgtttctttagccacacagttggtcattttttcattaatgtgacaactagtccaagcactggaataaaaacagagtaccatacaaatatttcttaaagcaaatagctactttgttcccttctttatctactttctagatacagtttccccaaagattaaccacaacttacttaaaaaaaaataccaaagcaatcttgggattttaatgagtccgctactctaactaactttcacctacactaggatattgtgctttaactactaaggagtaagaaaattttaggaagtaaaatagtctaaaattatcctataaactttgtatgatagatattattctctattaaaatcttatatacttcctaaatatttttaaagtggtcataaagcatttatttctctcgctgatctaacaacataaacatctaaaatttattttcattgtatgcaataaagcataagattacatgtatttttcttcaagactggagtcaaatatatatatatataagcatcttaaccctgtgattctcttacttccaaaattggtgataagagaaggaaaggcaagatttaccatatagtgagtgggtttaaaacttacactcagagttagactgtgttcttaatttaatacatttgacttgacttatttacagtttcaaagacactaacataaactacatcactaatcaggcataagtgtctgaagaagcagatcacgtcttcatacctactaaaggacattttaaccaccttgtcattggccagtagattgcactgatggagtgctggagaacagcatcacccttctgcattatctggaagtaagagccagtattaactccttcctggttcatctagcaccttaacctgagctgggtgtgcttcagcatgttgaccatgtgactgacacttagcacatacaattttttagattcccagcgggtagagaccaatgttttacctatattcttgtaaatggtggtagcaaaattaactgtgatatatagtgattgtgctaatgttagaaatcactctagactattccctgaatgctctaaaggtaaaacaagtgaccaaacagaaaccaagattgccaaaatgctggaggaacatcaatgggaagtgtaaaaggaagaagagtgggagcatgaacctctctaagagcctttgtctgtgcagctagagaaaagtcagaacacagcacctgaaatagaaatgttctatctcagctctaacttaggtagaaataggattttataatatgaggggatgtctggttcacaccttatgggaattgaatctttttgtactctttttaaacataaaagtcattatagggtatgtaaaaagaaaatacaactttacaaaggtttctcaacaaaaagaatttttacagagccatggggcagtaatcatccgacctgaaaaatagccttagatccctcataaaatagtgctttgagaatatgaggctagatttttattttctaataaaagatcctaaaattattagtgaagctaagttgtctaagtggactgtaaaaatgtcccaccagcaagctggataaagcttagtgctaatctcagaggtgacagagagggagtctcatgatgcctgagataatttctggccattagtggtgttcacgttacagttacattacaatttgaaatgaaagatgtttaaccttttttttacagaatactctaaaatagcgataataacacatcatttgtctatctgatacaacttcataatatttatagatacttttgaccctataacatattatccctattgaattctttctgccagatcactagacttaaaaaaaaaaaaaaaaaaaaaaaaaaaagatttagaaaataaatctggtttgatttgggagaagctagaaagtaaatgacccctacctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcagctggtgcttgtgaggtaaatggtatatttgtgggtcccataaatacacctgcaccacaaaaagaaaatgaatgaagacagagctatcacgtgtagttgcactcatctctataatcacagaaaaattgcctttctgaactactcacagcaaacattttaattccagtttggctgctcctactactcagaccaacccacacctaaaccctgagagctggttgtttctaggatgcagacaaatcagttattaacctgagtaaatttaattaagaaatgtaaatcatatgcaacagccacacaaaatatcttccactgtgaagaccaaactatgtagcatgacatcatacactgttttattgctgatttgtaccactggtcccccagtacgaaacagggaagtgagagctgactatatctcgcttcaataggtgtagtgggctgcccaacaattttagctcacatgtgaaatgcagctcattattttaaaggaaatggtgtgaaagattaaaactctgtaaacaataaggcttatgctaatattttgttatgattacaaaaaaattcatagattttttttaatccatgtggtaactcaagactgtttacctgcagagaaaatacactgtacgcagtcataaacttcatgcaaatcgtttcaataattcatcaaagataatccatgttctataagcttgtgaaacaacatttagtgatctatgaacagcttgttaattccaaataaagttctgtgaatcctgtacatgcctcttaattttttaattctaatgctcattcatttcggcttcatagttgtataaactgcaacaacaaaagcactcactacatggaacaataaaagatatataattgatcttattatataattacaaaggatgtacttctagtaatgtcactgaaagcagatatcaaaattcattaccaggagtactttgctgttgaatggttcctgtgccatacagagataagatggagtctttggaaagttgtttctttgccacttcttctgattttgtagtttgctcagtgaataaatctagatccccagatgttactgtagacagggttgcagctgctggtgcagagggtgtcccctgagacaaacaccaaaataagctatcaaattctgcatagtaaagcgcagcttatccattacttaaaatccaaataaagttataaaattagataggaatcaaacaattgtagaaggtaaaatggtgccattcaagaggatcacttacaagcccaagcccatataaaaacatctacaatca

SEQ ID NO: 111422 - DNA, 5206 bp, Homo sapiens
  Payload ID: 1820
  Gene Symbol: B3GAT2
  Gene Name: beta-1,3-glucuronyltransferase 2
  ENST ID: ENST00000615536
  CDS Start-End: 1-756
atgaagtccgcgcttttcacccgcttctttatcctcctgccctggatcctaattgtcatcatcatgctcgacgtggacacgcgcaggccagtgcccccgctcaccccgcgcccctacttctctccctacgcggtgggccgcgggggcgcccgactcccgctccgcaggggcggcccggctcacgggacccaaaagcgcaaccagtctcggccgcagccacagccggagccgcagctgcccaccatctatgccatcacgcccacctacagccgcccggtgcagaaagcggagctgacccgcctggccaacacgttccgccaggtggcgcagctgcactggatcctggtggaggacgcggcggcgcgcagcgagctgatgcgaaccacccgcaaggtctccgtctggcctgtgggcctggttggtgggcggcgctacgaacgtccgctggtggaaaacggcaaagttgttggctggtacaccggctggagagcagacaggccttttgccatcgacatggcaggatttgctgtaagtcttcaagtcattttgtccaatccaaaagctgtatttaagcgtcgtggatcccagccagggatgcaagaatctgactttctcaaacagataacaacagtcgaagaactggaaccgaaagcaaataactgcactaaggttctcgtgtggcacactcggacagagaaggttaatctagccaacgagccaaagtaccacctggacacagtgaaaattgaggtataaattgaagcagcaactggtgcagtttgtccagccagtggatccatatggaagaggatgtttggagtttaggctacagagcattcaggtattgtttgttttacttcagtacagcagcctttcttgtcatctgatggacatctgtttaaatggagcttgtcagttaacataagctaattggatggttggtacaaaatgtatgttttgtcttcatttgttctgcatgttttctctacaacaactaaattggaagatttttttgtacagtgccgatactgcaagataccactcttgagtatatattttttctttttctccaatttgcccttataattggtagacttgaacaggttggtagacttgaacaggtttttaaaacagacaagtattttgtcagctaaacgttcctgatgattcctgactttgcaatactaagtaatttttggaaggttagtggcagtatacatcataggaaataaaaacccacaaatgaaaaggtctatggagtcatgtttaatgtagggaaataacattttgtcaatactaggcaccataaaatgtaaacacaattactgtcataaacctagatataccttcaaggattgaagattgaaagtggctttgttttagttagttaccctgtttgcatatagtgcagaaaaaggtcttcatgttagcactatgtacattaagaagagatccaaattacaagagaggcagataaaatttgaattctttaagcattcattaaacgaagttttggagtaacatccacgtttatcttcctttcactaatcacgttccctgttaagcacatcataacaacagcacagtgaagtgaatgatgaaataagagcattttgatacactagaaaacagtgctcagtgagacatttacattctatttatatgattaaacatttgatcatacagtaccttcctacaggattactggctaattttggggtggggtttatactattagaggtattactaacatgataactacttcccttatatgcaaacattagagctataattttattgagaggaaaactgattttgcaagttgagcagcttctcaaataatgcagtacatgaaatcatgggaaatatgagcaaagctgcccttgacataaaatgatttatcaacctgcttttcaccacatcaaattgaatcagtacagaccaacacggtcaatcagatcattcttaatatgaacaaatgggtaaaaagaaaaaaaatatgcatatgaataaacaggggaactagatgcgtttcagcaaggaatgtcaggtggtagttctggatgaaacttgtattgcagttttcatttccacagttgtgtgctgagagtctgacctgatgagcttccagaccatcctgctgttgtgctggagggctggccaaaacctgcagtaggggttgcactactgatactcatgccagccatctgctgattcatctgtgaaacatataaaaggcttagttcaagaggcttacttcacttttaattcttgtttctttagccacacagttggtcattttttcattaatgtgacaactagtccaagcactggaataaaaacagagtaccatacaaatatttcttaaagcaaatagctactttgttcccttctttatctactttctagatacagtttccccaaagattaaccacaacttacttaaaaaaaaataccaaagcaatcttgggattttaatgagtccgctactctaactaactttcacctacactaggatattgtgctttaactactaaggagtaagaaaattttaggaagtaaaatagtctaaaattatcctataaactttgtatgatagatattattctctattaaaatcttatatacttcctaaatatttttaaagtggtcataaagcatttatttctctcgctgatctaacaacataaacatctaaaatttattttcattgtatgcaataaagcataagattacatgtatttttcttcaagactggagtcaaatatatatatatataagcatcttaaccctgtgattctcttacttccaaaattggtgataagagaaggaaaggcaagatttaccatatagtgagtgggtttaaaacttacactcagagttagactgtgttcttaatttaatacatttgacttgacttatttacagtttcaaagacactaacataaactacatcactaatcaggcataagtgtctgaagaagcagatcacgtcttcatacctactaaaggacattttaaccaccttgtcattggccagtagattgcactgatggagtgctggagaacagcatcacccttctgcattatctggaagtaagagccagtattaactccttcctggttcatctagcaccttaacctgagctgggtgtgcttcagcatgttgaccatgtgactgacacttagcacatacaattttttagattcccagcgggtagagaccaatgttttacctatattcttgtaaatggtggtagcaaaattaactgtgatatatagtgattgtgctaatgttagaaatcactctagactattccctgaatgctctaaaggtaaaacaagtgaccaaacagaaaccaagattgccaaaatgctggaggaacatcaatgggaagtgtaaaaggaagaagagtgggagcatgaacctctctaagagcctttgtctgtgcagctagagaaaagtcagaacacagcacctgaaatagaaatgttctatctcagctctaacttaggtagaaataggattttataatatgaggggatgtctggttcacaccttatgggaattgaatctttttgtactctttttaaacataaaagtcattatagggtatgtaaaaagaaaatacaactttacaaaggtttctcaacaaaaagaatttttacagagccatggggcagtaatcatccgacctgaaaaatagccttagatccctcataaaatagtgctttgagaatatgaggctagatttttattttctaataaaagatcctaaaattattagtgaagctaagttgtctaagtggactgtaaaaatgtcccaccagcaagctggataaagcttagtgctaatctcagaggtgacagagagggagtctcatgatgcctgagataatttctggccattagtggtgttcacgttacagttacattacaatttgaaatgaaagatgtttaaccttttttttacagaatactctaaaatagcgataataacacatcatttgtctatctgatacaacttcataatatttatagatacttttgaccctataacatattatccctattgaattctttctgccagatcactagacttaaaaaaaaaaaaaaaaaaaaaaaaaaaagatttagaaaataaatctggtttgatttgggagaagctagaaagtaaatgacccctacctgtgagaggctccactggggctgctgagcttgcggcaggccaaacttactctggggtgcacccatttgtcccaccattcctccttgggggccaacaacgttctgaggaagtggcatcacaccagtttgtgcatttcccataaacccattgggcatgggcatgcccaccatcatgcttggactctgtcccatcacatttcctataaggccaggagctgcaggcacaggcacgcccatcgatggaaagccctgaaatgcagctggtgcttgtgaggtaaatggtatatttgtgggtcccataaatacacctgcaccacaaaaagaaaatgaatgaagacagagctatcacgtgtagttgcactcatctctataatcacagaaaaattgcctttctgaactactcacagcaaacattttaattccagtttggctgctcctactactcagaccaacccacacctaaaccctgagagctggttgtttctaggatgcagacaaatcagttattaacctgagtaaatttaattaagaaatgtaaatcatatgcaacagccacacaaaatatcttccactgtgaagaccaaactatgtagcatgacatcatacactgttttattgctgatttgtaccactggtcccccagtacgaaacagggaagtgagagctgactatatctcgcttcaataggtgtagtgggctgcccaacaattttagctcacatgtgaaatgcagctcattattttaaaggaaatggtgtgaaagattaaaactctgtaaacaataaggcttatgctaatattttgttatgattacaaaaaaattcatagattttttttaatccatgtggtaactcaagactgtttacctgcagagaaaatacactgtacgcagtcataaacttcatgcaaatcgtttcaataattcatcaaagataatccatgttctataagcttgtgaaacaacatttagtgatctatgaacagcttgttaattccaaataaagttctgtgaatcctg

SEQ ID NO: 111423 - DNA, 1641 bp, Homo sapiens
  Payload ID: 1821
  Gene Symbol: B3GAT3
  Gene Name: beta-1,3-glucuronyltransferase 3
  Uniprot ID: O94766
  ENST ID: ENST00000265471
  CDS Start-End: 229-1236
gggaccggaaatcaagtctacaaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgga

SEQ ID NO: 111424 - DNA, 2056 bp, Homo sapiens
  Payload ID: 1821
  Gene Symbol: B3GAT3
  Gene Name: beta-1,3-glucuronyltransferase 3
  ENST ID: ENST00000531383
  CDS Start-End: 208-1167
aaggcgggggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcggagtctcgctgtgtcacccaggctggagtgcagtagcgcaatcttggcttagcgcaagctccgcctcccgggttcacaccattctcctgcctcagcctcccaagtagctgggactacaggcacccgctaccacgcccggctaatttttttgtgtttttagtagtgacggggtttcacggtgttagccaggatggtctcaatctcctgacctcgtgatccgccttcctcggcctcccaaagtgctggggttacaggcgtgagccacgcgcccggccaaggcccggttttagaggcactaagtcttcctccaccctgccctttacactttgaagcctatactgtatatgtcgatagggttagagaatccattccaggctcggggacccagaggcctggctgcagctgggcctggctctcactgcatccctcctggcacaggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacagaaggacagatggacccaggagggagggcagctgagtaactgggtaacttattggggctgggcatgcactggggggctggaggagctgggctggacccttcccacctgagcatgctgacccccttcctacctccagaataaagaatctcaacctgg

SEQ ID NO: 111425 - DNA, 1120 bp, Homo sapiens
  Payload ID: 1821
  Gene Symbol: B3GAT3
  Gene Name: beta-1,3-glucuronyltransferase 3
  Uniprot ID: O94766
  ENST ID: ENST00000534026
  CDS Start-End: 38-985
agaccccgcctgctcgggcgcgggcggcggcgcggccatgaagctgaagctgaagaacgtgtttctcgcctacttcctggtgtcgatcgccggcctcctctacgcgctggtacagctcggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcggacagagtctcgctgtgtcacccaggctggagtgcagtagcgcaatcttggcttagcgcaagctccgcctcccgggttcacaccattctcctgcctcagcctcccaagtagctgggactacaggcacccgctaccacgcccggctaatttttttgtgtttttagtagtgacgggg

SEQ ID NO: 111426 - DNA, 1534 bp, Homo sapiens
  Payload ID: 1821
  Gene Symbol: B3GAT3
  Gene Name: beta-1,3-glucuronyltransferase 3
  ENST ID: ENST00000532585
  CDS Start-End: 38-154
agaccccgcctgctcgggcgcgggcggcggcgcggccatgaagctgaagctgaagaacgtgtttctcgcctacttcctggtgtcgatcgccggcctcctctacgcgctggtacagctcgtgtctgcttcctccactaaacagaaagctcgatgagggcagggactgtgtctgttttgttccctgctgtatccccagcacctaaggcagtgcctcctaggaagagtattcaataaatatttatcctacgatggaatcaatgaatttaacaatgagtctttggtcacctagccaagggaatggatcgaaccctgccccttatgcaaagatttagggacagtgccactgcgttatcctcaggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagccgggagctgtttgaggagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtactggtgtggcatactcggacagagaagcccaagatgaagcaggaggagcagctgcagcggcagggccggggctcagacccagcaattgaggtgtgatggcggccccaccccaactaccacctcttttcaggcacagaccttgtgggactgggccccaggcctgcccaggatgtggttttccaagtcctgacccttggagccagaagtggcccctctgcccctccaggcccagggcatggtcctgctgcttcacccctcccctagcctgccgtgtggcactgcccacaggctggggacaagcagcccttgtgttgagtcaggttggccctgtctagggtggaacaga

SEQ ID NO: 111427 - DNA, 868 bp, Homo sapiens
  Payload ID: 1821
  Gene Symbol: B3GAT3
  Gene Name: beta-1,3-glucuronyltransferase 3
  ENST ID: ENST00000534715
  CDS Start-End: 200-868
ggggtgcacagatgaccggaagcgtgccctggcggcgctgccagccccagctgggagctggtaggggagtgcgaggaaggcgggacgcagggcggagccgctgcaggggcggggcctgcggacaggagccggggtttggggcgggaacccctcgtcccctgcagaccccgcctgctcgggcgcgggcggcggcgcggccatgaagctgaagctgaagaacgtgtttctcgcctacttcctggtgtcgatcgccggcctcctctacgcgctggtacagctcgccaagggaatggatcgaaccctgccccttatgcaaagatttagggacagtgccactgcgttatcctcaggccagccatgtgactgccttcctcccctgcgggcagcagccgagcagctacggcagaaggatctgaggatttcccagctgcaagcggaactccgacggccaccccctgcccctgcccagccccctgaacccgaggccctgcctactatctatgttgttacccccacctatgccaggctggtacagaaggcagagctggtacgactgtcccagacactgagcctggtgccccggctgcattggctgctggtggaggatgctgagggtcccaccccgctggtctcagggctgctggctgcctctggcctcctcttcacacacctggtggtcctcacgcccaaagcccagcggcttcgggagggcgagcctggctgggttcatccccgtggtgtcgagcagcggaacaaggccctggactggctccggggcagagggggtgctgtgggtggggagaaggacccaccaccaccagggacccaaggagtcgtctactttgctgacgatgacaacacctacagc

SEQ ID NO: 111428 - DNA, 3270 bp, Homo sapiens
  Payload ID: 1822
  Gene Symbol: B3GALNT1
  Gene Name: beta-1,3-N-acetylgalactosaminyltransferase 1 (globoside blood group)
  Uniprot ID: O75752
  ENST ID: ENST00000320474
  CDS Start-End: 399-1394
gtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 111429 - DNA, 3221 bp, Homo sapiens
  Payload ID: 1822
  Gene Symbol: B3GALNT1
  Gene Name: beta-1,3-N-acetylgalactosaminyltransferase 1 (globoside blood group)
  Uniprot ID: O75752
  ENST ID: ENST00000392779
  CDS Start-End: 350-1345
ttccggccgcggccctggcgcgtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 111430 - DNA, 3606 bp, Homo sapiens
  Payload ID: 1822
  Gene Symbol: B3GALNT1
  Gene Name: beta-1,3-N-acetylgalactosaminyltransferase 1 (globoside blood group)
  Uniprot ID: O75752
  ENST ID: ENST00000392781
  CDS Start-End: 749-1744
gcgtggtctgcgcgcgcccggccgtgcgtgcggatgcggggaggctgcgtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgta

SEQ ID NO: 111431 - DNA, 1107 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000417187
  CDS Start-End: 64-339
ctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgaaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaa

SEQ ID NO: 111432 - DNA, 584 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000460353
  CDS Start-End: 134-584
gtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttct

SEQ ID NO: 111433 - DNA, 541 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000498216
  CDS Start-End: 380-541
ggcccaggccgcggccgcgccgcatccgctggttgtccaccttgccttgccccagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgag

SEQ ID NO: 111434 - DNA, 2123 bp, Homo sapiens
  Payload ID: 1822
  Gene Symbol: B3GALNT1
  Gene Name: beta-1,3-N-acetylgalactosaminyltransferase 1 (globoside blood group)
  Uniprot ID: O75752
  ENST ID: ENST00000473285
  CDS Start-End: 352-1347
cacttttccaagcagtaaggaatgatgccatcctcaagtacggattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaa

SEQ ID NO: 111435 - DNA, 662 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000492353
  CDS Start-End: 467-662
agagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaaaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttca

SEQ ID NO: 111436 - DNA, 666 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000494173
  CDS Start-End: 578-666
gtgcagccaggggcttccggccgcggccctggcgcgtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagttt

SEQ ID NO: 111437 - DNA, 914 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000468268
  CDS Start-End: 582-914
gtgtgtgcgcagggagagaacgccggccaccttcccgcttccgagctgggtgcgcgccgagcacaggagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgag

SEQ ID NO: 111438 - DNA, 552 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000484127
  CDS Start-End: 429-552
gagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagagacaaggccactttatgtttcccaggctggactggaacccctgggctcaaatgatcctcctacctaagcctgcagagtagcgaggacttcagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactaca

SEQ ID NO: 111439 - DNA, 1660 bp, Homo sapiens
  Payload ID: 1822
  Gene Symbol: B3GALNT1
  Gene Name: beta-1,3-N-acetylgalactosaminyltransferase 1 (globoside blood group)
  Uniprot ID: O75752
  ENST ID: ENST00000488170
  CDS Start-End: 665-1660
gcgccgtcctcggaaacgcctagaccccggcagctaggccgggaggcaccgcccactcctctagagcggagcgtggcccaggttgagccgccgcaccgtgggtctcgggtctcggtgacgagcagctgcccgcctccggtgagcgcgggagaaggggcccagtggggcagtgggcgacgcggagggcccaggcccaggccgcggccgcgccgcatccgctggttgtccaccttgccttgccccagggtgcaatacctgccttgcgtcgcccgtgccgctccagccaccgtcaaatccgggtagcgacccggggcgtttgcagcggtgccgaggaagaggacgggaacggtgttacgattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaa

SEQ ID NO: 111440 - DNA, 572 bp, Homo sapiens
  Payload ID: 1822
  Gene Symbol: B3GALNT1
  Gene Name: beta-1,3-N-acetylgalactosaminyltransferase 1 (globoside blood group)
  ENST ID: ENST00000473142
  CDS Start-End: 397-572
tgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagtcttgctgctctgttgcccaggctggagtacagtggcaggatctcagctcactgcaatctccgtctctcaggtttaagcagttctcctgcctcagcctcccaagtaggtgggactacagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgattta

SEQ ID NO: 111441 - DNA, 1874 bp, Homo sapiens
  Payload ID: 1823
  Gene Symbol: B3GALNT2
  Gene Name: beta-1,3-N-acetylgalactosaminyltransferase 2
  Uniprot ID: Q8NCR0
  ENST ID: ENST00000313984
  CDS Start-End: 171-1151
ggaggagcggggccgggagctgcgaggagccccccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcaggtggagtctcactcttgttgcccaggctggagtgcaatggcgcggtctcggctcaccccaacctccacctcccgggttcaagagattctcctgcctcagcctcccaagtagctgggataacagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaggatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcagggtaagtttgctagttgaaacttgaaaagtacactgaatgtcttatacttaatctttatacttgagagaaaaggattttttcttttttgtcttttaaaaaactttattcagataaaattcacccttttaaagtggttcagtggttttagtgtattcttagagttctacaaccggctccacctcccaaaaggaaaccccacacccattagcagttactcctcattcttacctccccaaccccccaccccctaacaactactgatgcactttctttctctatggatttgcctgttttgaacatttcacataaatggaaatgcacagtacgtactctgtgtgtcagtttctttgctgtaacatgtgttccaggtctgtccattttgtatgtatcagtacttcttttttatgatcatataatattctattgcatcgatatgccctattttattcattcattaatggatggacatttagattgcttctactttttgaatatgaataattctgtagtaaacatgtaggtacaagtttttgtgtggtcatatatttccatttctcttaaatgtctaggagtagaagacctgggtcatataattgtgtgtttaatcacttgaggcactgccaggttgttttctaaagcagcagcccactttacatttccatagtcagtatatgaggattctagtttctccatattcttgtcaacacttaataaattgtctgtcttttaaaatataccaa

SEQ ID NO: 111442 - DNA, 2015 bp, Homo sapiens
  Payload ID: 1823
  Gene Symbol: B3GALNT2
  Gene Name: beta-1,3-N-acetylgalactosaminyltransferase 2
  Uniprot ID: Q8NCR0
  ENST ID: ENST00000366600
  CDS Start-End: 230-1732
aggcggagggggcggggcttcggccggctaagccgcggccacccgcggtctgagggaccggaggagcggggccgggagctgcgaggagccccccagacgtcgccgagcgcgagggcgggcgtgctcggagtggtcgctcgtcagccgccgcccctcagtctccgcacttgcaggtcccctccctctccgccgggacgcgggagagcccggctcgcggcgggggcggccaatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgtgtgcttgtgaagttcataataggtgctcatggctgtgaagtgcctgtggaagacagggaggatccttattcctgtaaactactcaacatcacaaatccagttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcaggaaggtgatgctctcttacacaaccttcattctcgccctcaaagacttattgatcatataaggaatctccatgaggaagatgccttactgaaggaggaaagcagcatctatgatgatattgtttttgtggatgttgtcgacacttatcgtaatgttcctgcaaaattattgaacttctatagatggactgtggaaacaacgagcttcaatttgttgctgaagacagatgatgactgttacatagacctcgaagctgtatttaataggattgtccaaaagaatctggatgggcctaatttttggtggggaaatttcagactgaattgggcagttgaccgaaccggaaagtggcaggagttggagtacccgagccccgcttaccctgcctttgcatgtgggtcaggatatgtgatctccaaggacatcgtcaagtggctggcaagcaactcggggaggttaaagacctatcagggtgaagatgtaagcatgggcatctggatggctgccataggacctaaaagataccaggacagtctgtggctgtgtgagaagacctgtgagacaggaatgctgtcttctcctcagtattctccgtgggaactgacggaactgtggaaactgaaggaacggtgcggtgatccttgtcgatgtcaagcaagataacagggacttgaattagcagagtctaaaatcagggcaggcaaacgataatctgagtgcaagtctgaggagtcccagggtttagcagtagactgtatggtctttcaagagagttccagactggcactttcacccagaaccaatgcggtgtttcttaatgtttgcacaaatttccttaaaaatcaacttgtactgtagcataagaaaagtttttatttatctattggaagattatcagaaaaataccaagttattttataaaagaaaaaatatttctaaatcctga

SEQ ID NO: 111443 - DNA, 2920 bp, Homo sapiens
  Payload ID: 1823
  Gene Symbol: B3GALNT2
  Gene Name: beta-1,3-N-acetylgalactosaminyltransferase 2
  ENST ID: ENST00000612859
  CDS Start-End: 3-281
caatgcgaaactggctggtgctgctgtgcccgtgtgtgctcggggccgcgctgcacctctggctgcggctgcgctccccgccgcccgcctgcgcctccggggccggccctgcagatcagttggccttatttcctcagtggaaatctactcactatgatgtggtagttggcgtgttgtcagctcgcaataaccatgaacttcgaaacgtgataagaagcacctggatgagacatttgctacagcatcccacattaagtcaacgttttgaatcaggaaattgaagcgttcagtctgtccgaagacacttcatcggggctgcctgaggatcgagttgtcagcgtgagtttccgagttctctaccccatcgttattaccagtcttggagtgttctacgatgccaatgatgtgggtttccagaggaacatcactgtcaaactttatcaggcagaacaagaggaggccctcttcattgctcgcttcagtcctccaagctgtggtgtgcaggtgaacaagctgtggtacaagcccgtggaacaattcatcttaccagagagctttgaaggtacaatcgtgtgggagagccaagacctccacggccttgtgtcaagaaatctccacaaagtgacagtgaatgatggagggggagttctcagagtcattacagctggggagggtgcattgcctcatgaattcttggaaggtgtggagggagttgcaggtggttttatatatactattcagggtaagtttgctagttgaaacttgaaaagtacactgaatgtcttatacttaatctttatacttgagagaaaaggattttttcttttttgtcttttaaaaaactttattcagataaaattcacccttttaaagtggttcagtggttttagtgtattcttagagttctacaaccggctccacctcccaaaaggaaaccccacacccattagcagttactcctcattcttacctccccaaccccccaccccctaacaactactgatgcactttctttctctatggatttgcctgttttgaacatttcacataaatggaaatgcacagtacgtactctgtgtgtcagtttctttgctgtaacatgtgttccaggtctgtccattttgtatgtatcagtacttcttttttatgatcatataatattctattgcatcgatatgccctattttattcattcattaatggatggacatttagattgcttctactttttgaatatgaataattctgtagtaaacatgtaggtacaagtttttgtgtggtcatatatttccatttctcttaaatgtctaggagtagaagacctgggtcatataattgtgtgtttaatcacttgaggcactgccaggttgttttctaaagcagcagcccactttacatttccatagtcagtatatgaggattctagtttctccatattcttgtcaacacttaataaattgtctgtcttttaaaatataccaatcctagtgggtgtaaattgttatttcattgtgatttttattcgtatttccataataactaatgatgttgagcattttcttcatgtgcttattggccatttgtatatcttccttttttgtttcgttgtttttctttttttctgagacgaggcctcactctgttgcccaggctggagtgcagtggcatgatcacagctcactgtagccttgacctccccgggctcaagtgaacttcccatttcagcctcccgaatagctgggactacaagtgcatgccaccatgcccagctaattattaaatgttttgtagagacagggttttgtcatattgctgaggctgcacactgttaacagggtgaattattatggtatatgaactagatgtgggaagtgagggagggaggagggggaggaagtgagggaggaaggggtggagagagggagaaggtggtgagggagggaggggtggagggaagaagggaggaaaggaggggagagagagtcatttgtatatctttagagaaatatctattcagatcctttgcccatttataaaattattttattgttgaattgtaagagttctttatatatgctggatacaagtcccttatcagatacatgctttgcaaatggtgccctttaacacacaaaagttgtaaattttgatgaagtccaattttgtcacatgtttttgctgtcatatgtaaggaactattgtctaatgtgaggtcacaaagatttgtgcctttgttttacagttccaagagttttatagttttagcacttatacgtaggtcttggatccatgttcattttcatatatggcatgaaatagaggtttaacttcattcttttgcatgtggatatccagttgtcccagcacccatttgttgaaaatcagtgactgtagatgtaaggatttacttgaggactctcaattctattccattgatctatgtgtctgcgtctttaaccagtactacactgtcttgattatgtagctttttagtaagatttgaaattgggaggctgggcacggtggctcactcctgtaatcccagcactttgggagcccgaggcaggtggatcacgaggtcaggagttcgagaccagcctgaccaacatggtgaaaccctgtctctactaaaaatacaaaaaaattagccaggcatggtgtcgggcgcctgtaatcccagctactccagaggctgaggcagaagaatcgcttgaacctgggaggcagaggttgcattgagctgagattgccactgcatttcatcctgggtgacagcaagactccgtctcaaaaaaaaaaaaaaaaaaaaaagaaattaggaaatgtgaatcctccaaccttgttctttttcaagcttgattggctattctgggtctcttgcacttccatatgaattttatgatcagcttgttaatttgtg

SEQ ID NO: 111444 - DNA, 1874 bp, Homo sapiens; identical to SEQ ID NO: 111441
  Payload ID: 1823
  Gene Symbol: B3GALNT2
  Gene Name: Beta-1,3-N-acetylgalactosaminyltransferase 2
  ENST ID: ENST00000635244
  CDS Start-End: 171-1151

SEQ ID NO: 111445 - DNA, 2920 bp, Homo sapiens; identical to SEQ ID NO: 111443
  Payload ID: 1823
  Gene Symbol: B3GALNT2
  Gene Name: Beta-1,3-N-acetylgalactosaminyltransferase 2
  ENST ID: ENST00000635195
  CDS Start-End: 3-281

SEQ ID NO: 111446 - DNA, 2015 bp, Homo sapiens; identical to SEQ ID NO: 111442
  Payload ID: 1823
  Gene Symbol: B3GALNT2
  Gene Name: Beta-1,3-N-acetylgalactosaminyltransferase 2
  ENST ID: ENST00000635453
  CDS Start-End: 230-1732

SEQ ID NO: 111447 - DNA, 2072 bp, Homo sapiens
  Payload ID: 1824
  Gene Symbol: B4GAT1
  Gene Name: beta-1,4-glucuronyltransferase 1
  Uniprot ID: O43505
  ENST ID: ENST00000311181
  CDS Start-End: 148-1395
gggcggcgggcggggcggcgctcggggctcggctggcctcggctcgcctcggctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccaca

SEQ ID NO: 111448 - DNA, 3036 bp, Homo sapiens
  Payload ID: 1825
  Gene Symbol: B4GALNT1
  Gene Name: beta-1,4-N-acetyl-galactosaminyl transferase 1
  Uniprot ID: Q00973
  ENST ID: ENST00000341156
  CDS Start-End: 586-2187
acgagcaggcaatggaatggatgtcgtgggagcaggcggttgagatgccagtgtttggaggctaaggactgggggctgtgagcgaggaccttcccgcgtttgctccgcgcccccgcagtttcctccgcgcccactagaaggcgccggggcgctcgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaagaacctaaggtggaaacactgtcctctcatcttgggaccgagggggtggggaagttccccaacacataatcccaagactgtgcccctcatctgcatcttcagatccagtactctgtgtacctgctccagccccacccccacagagagaacttgtggctctggggctggggtgagggctggtggttggtgaaagccattcttagttgtgtctctgcaatgctgtgggcacaaaagaaggggcaccagagtccctgtgcaaacacctagactcacttcatggattccaaagctctcagcttcattttattagttacgttaggtaagggggttcaagggtcatggtcctcatcacacacatgtcatcagggccctctgcactccacatgatgaggtcagacccacacggtgcaaatctttgggtcagtgagctcctggagaagagaggagacatgtcaggaatagattaggcacccctcttccttaatgaaatgtggcagtcctctcaggggtaccccacctacttagggatctgag

SEQ ID NO: 111449 - DNA, 1861 bp, Homo sapiens
  Payload ID: 1825
  Gene Symbol: B4GALNT1
  Gene Name: beta-1,4-N-acetyl-galactosaminyl transferase 1
  Uniprot ID: Q00973
  ENST ID: ENST00000418555
  CDS Start-End: 109-1545
tcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaaatggggggatcactttccaagtgccaaagagcccagagggactctaag

SEQ ID NO: 111450 - DNA, 837 bp, Homo sapiens
  Payload ID: 1825
  Gene Symbol: B4GALNT1
  Gene Name: beta-1,4-N-acetyl-galactosaminyl transferase 1
  ENST ID: ENST00000551220
  CDS Start-End: 477-837
gctcgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcagg

SEQ ID NO: 111451 - DNA, 1945 bp, Homo sapiens
  Payload ID: 1825
  Gene Symbol: B4GALNT1
  Gene Name: beta-1,4-N-acetyl-galactosaminyl transferase 1
  ENST ID: ENST00000552798
  CDS Start-End: 117-812
gaggccactcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttggttcccttcgggttggctcctgctccgacgtcgtggtggatcatgcatccaaactgaagctgccttggacatcaagggatgccggagcagagacttacgcccggtaccgttacccaggatcactggacgagagccagatggccaaacaccggctgctcttcttcaaacaccggctgcagtgcatgacctcccagtgatggcccgctggggatttctgactgtcaggctgggcctgcctccttgtccctgccaggaatttccaacaaaccccaccaccctgtgagcactctactggctgtccctgagcctctagttcctcactcttccttttcagaacctgatgcccagtaggggttgtcctggtgacacccctcctttttccagtgcccagaggcctggtggagccataacctctcccacagccagtgccaagtcctccccctgcccattctcatggggcaggaa

SEQ ID NO: 111452 - DNA, 879 bp, Homo sapiens
  Payload ID: 1825
  Gene Symbol: B4GALNT1
  Gene Name: beta-1,4-N-acetyl-galactosaminyl transferase 1
  ENST ID: ENST00000549391
  CDS Start-End: 1-383
ggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagggtcaaatgccatgtcctttcttcccagtccggttctccaccgagggacatgaggctgctttcactatccgcataagacacccgcccaaccctcggctgtacccacctgggtctctaccccagggagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaagctcctggcctttcgaaagcactcaaaagtctggagaagaatacaagctgagaagggtcgggggagagaaagaaaggtggcagagggccatgtcctatttctgcagcctccccaaccacacacacctttctgccagggctggttcgcaggccggaacctggccgtgtctcaagtaaccaccaagtacgtgctgtgggtggacgacgacttcgtcttcacggcgcggacgcgg

SEQ ID NO: 111453 - DNA, 841 bp, Homo sapiens
  Payload ID: 1825
  Gene Symbol: B4GALNT1
  Gene Name: beta-1,4-N-acetyl-galactosaminyl transferase 1
  ENST ID: ENST00000548888
  CDS Start-End: 130-841
cgcgccgcttgccgaggccactcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacag

SEQ ID NO: 111454 - DNA, 502 bp, Homo sapiens
  Payload ID: 1825
  Gene Symbol: B4GALNT1
  Gene Name: beta-1,4-N-acetyl-galactosaminyl transferase 1
  ENST ID: ENST00000552219
  CDS Start-End: 111-401
actcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtgggagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttc

SEQ ID NO: 111455 - DNA, 1649 bp, Homo sapiens
  Payload ID: 1825
  Gene Symbol: B4GALNT1
  Gene Name: beta-1,4-N-acetyl-galactosaminyl transferase 1
  Uniprot ID: Q00973
  ENST ID: ENST00000552350
  CDS Start-End: 130-1116
cgcgccgcttgccgaggccactcatcgggtcacctccgccgggggcgcccgccagcacgggcatgattctgcattttttcctgacaggctaggtgtggagccgccctccgcagcccaccccggcccaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggtgcaaggcctgggtggagagacgggcaggctgggcaaacagagaagaaccagaaaggctggagtgggcaaatggcagagggcatgggaggcatctgggctatggccagagctgtccagccacacaatgggtgcttcaactggaccagcagggccagagggagaaagggggcctttgttcatctggggctggagcaggccagagggaaacccgagccttgggtgtgtctcccctttaggccaactgtggggggccccaggaagagacttgtctaaggagttagaagactatattcccaacccaccccttactagagggcaaaggtctttactttcctgagatcccatttctcttccagcaaaagaggcctaaaagccctctttgcttctccccaaagctggtttgttgcactaagtttgcttccaccttagggcctttgcactttctattttctcagcctggaatgctcttccccagatttttgcagactggcttcttcttgtcatttagatctcagttcaaatgcctcctcttcactatcacattacttgtttgtcttattttccactcaatacttaccagtatctgaattttttaatttacttagcctggcaccagactgactaggttgctatcagttttgttgcttaatagttgtgtaaatgtggcaagttacttttctgtgtctcagcttttttttctgttgtaggaatctacttaatagggctatcatggggataaaatgagtgcatatatttaaggtaattttttaacgggtctggcacatagtaagtgctcaataaagatt

SEQ ID NO: 111456 - DNA, 453 bp, Homo sapiens
  Payload ID: 1825
  Gene Symbol: B4GALNT1
  Gene Name: beta-1,4-N-acetyl-galactosaminyl transferase 1
  ENST ID: ENST00000547741
  CDS Start-End: 1-453
tcatgcccttcggcaagggctggttcgcaggccggaacctggccgtgtctcaagtaaccaccaagtacgtgctgtgggtggacgacgacttcgtcttcacggcgcggacgcggctggagaggcttgtggacgtgctggagcggacgccgctggacctggcccgcctggaggcaacctccctctccctgcaggtggggggcgcggtgcgcgagatctccggctttgccaccacttatcggcagctgctgagcgtggagcccggcgccccaggcctcgggaactgcctccggcaaaggcgcggcttccaccacgagctcgtcggcttcccaggctgcgtggtcaccgacggcgtggttaacttcttcctggcgcggactgacaaggtgcgcgaggtcggtttcgacccccgcctcagccgcgtggctcatctggaattcttcttggatgggcttg

SEQ ID NO: 111457 - DNA, 562 bp, Homo sapiens
  Payload ID: 1825
  Gene Symbol: B4GALNT1
  Gene Name: beta-1,4-N-acetyl-galactosaminyl transferase 1
  ENST ID: ENST00000548487
  CDS Start-End: 174-419
aagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttagctgagggctgcctctgccacaagagagcaggagttccaggcctttctgtcgaggagccagtccccagctgaccagctgctcatagcccctgccaactccccgctccagtaccccctacagggtgtggaagttcagcccctcag

SEQ ID NO: 111458 - DNA, 1967 bp, Homo sapiens
  Payload ID: 1825
  Gene Symbol: B4GALNT1
  Gene Name: beta-1,4-N-acetyl-galactosaminyl transferase 1
  Uniprot ID: Q00973
  ENST ID: ENST00000550764
  CDS Start-End: 433-1419
cgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacaggtgcaaggcctgggtggagagacgggcaggctgggcaaacagagaagaaccagaaaggctggagtgggcaaatggcagagggcatgggaggcatctgggctatggccagagctgtccagccacacaatgggtgcttcaactggaccagcagggccagagggagaaagggggcctttgttcatctggggctggagcaggccagagggaaacccgagccttgggtgtgtctcccctttaggccaactgtggggggccccaggaagagacttgtctaaggagttagaagactatattcccaacccaccccttactagagggcaaaggtctttactttcctgagatcccatttctcttccagcaaaagaggcctaaaagccctctttgcttctccccaaagctggtttgttgcactaagtttgcttccaccttagggcctttgcactttctattttctcagcctggaatgctcttccccagatttttgcagactggcttcttcttgtcatttagatctcagttcaaatgcctcctcttcactatcacattacttgtttgtcttattttccactcaatacttaccagtatctgaattttttaatttacttagcctggcaccagactgactaggttgctatcagttttgttgcttaatagttgtgtaaatgtggcaagttacttttctgtgtctcagcttttttttctgttgtaggaatctacttaatagggctatcatggggataaaatgagtgcatatatttaaggtaattttttaacgggtctggcacatagtaagtgctcaataaagattagcttttacttaaaa

SEQ ID NO: 111459 - DNA, 1633 bp, Homo sapiens
  Payload ID: 1825
  Gene Symbol: B4GALNT1
  Gene Name: beta-1,4-N-acetyl-galactosaminyl transferase 1
  ENST ID: ENST00000449184
  CDS Start-End: 470-1384
agtttcctccgcgcccactagaaggcgccggggcgctcgcattccccgcgcggagccgaagcagccgcaacgagccgggagctgagccgcgctgcgctgcggtgcgaagagccgggcggcggccagagccctccccgcgctgccagtgggacgcggagccagggatccccggctttgccccggggctggggtgcaacagactcttaacttggtcctcgcgccccgccaaccgcccccgggcaggaaacgcccagaaccaccaccgcgccgcgctccacaaaagccccgggagttccaagacgggagggatcgggcgcgctccagaggcaggagggtcccccacaccctcaggctcatgcccagctcccccatcgggcagcccccagccccatgaggaccctcaggccggggcgagagcccggcacagcccggaccgaaattttgccgctgccttagagcgttagacaggatgtggctgggccgccgggccctgtgcgctctggtccttctgctcgcctgcgcctcgctggggctcctgtacgcgagcacccgggacgcgcccggcctccggctacctcttgcgccgtgggcgcccccgcaaagcccccgcaggcccgagctgccagatcttgctcctgagccccgctacgcacacatcccggtcaggatcaaggagcaagtagtggggctgctggcttggaacaactgcagttgtgagtccagtggggggggcctccccctccccttccagaaacaagtccgagctattgacctcaccaaggcctttgaccctgcagagctgagggctgcctctgccacaagagagcaggagttccaggcctttctgtcgaggagccagtccccagctgaccagctgctcatagcccctgccaactccccgctccagtaccccctacagggtgtggaagttcagcccctcaggagcatcttggtgccagggctgagccttcaggcagcttctggtcaggaggtataccaggtgaacctgactgcctccctaggcacctgggacgtggcaggggaagtgactggagttactctcactggagagggtcaggcagatctcacccttgtcagcccagggctggaccaactcaacaggcaactacaactggtcacttacagcagccgaagctaccagaccaacacagcagacacagcccagtacaacatcagcgctctagtcacgattgccaccaagaccttcctccgttatgatcggctacgggctctcatcaccagtatccgccgcttctacccaacggttaccgtggtcatcgctgacgacagcgacaagccagagcgcgttagtggcccctacgtggaacactatctcatgcccttcggcaaggtgtgcagctagcaggctgaacggcaggccagaggactcccgcagggggtgtgccctcaatctgcagcctccagggtagtgattcgaggaccacctgcctcagaatcatggggtgcctgttaagcatgaggattcctggaatgtaagcttcgtgggagcaggaaattctctctgaattcttagaatggtgcttagtgcctaatggcattcaataaaatagctgatgaatgaataaataaatgcacacggaaattaaacgca

SEQ ID NO: 111460 - DNA, 1906 bp, Homo sapiens
  Payload ID: 1826
  Gene Symbol: B4GALNT2
  Gene Name: beta-1,4-N-acetyl-galactosaminyl transferase 2
  Uniprot ID: Q8NHY0
  ENST ID: ENST00000300404
  CDS Start-End: 60-1760
ataggtggctgcagaggcgaggtgacggcgcgtgcggaacgaactctgcacccccaggaatggggagcgctggcttttccgtgggaaaattccacgtggaagtggcctctcgcggccgggaatgtgtctcggggacgcccgagtgtgggaatcggctcgggagtgcgggcttcggggctctctgcttggaactcagaggcgctgacccagcctggggcccgtttgctgcccacgggaggagccgccgtcagggctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtac

SEQ ID NO: 111461 - DNA, 8657 bp, Homo sapiens
  Payload ID: 1826
  Gene Symbol: B4GALNT2
  Gene Name: beta-1,4-N-acetyl-galactosaminyl transferase 2
  Uniprot ID: Q8NHY0
  ENST ID: ENST00000393354
  CDS Start-End: 25-1545
agtctgagggcggcgggattcgggatgacttcgggcggctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtaccaatcaaaggtgaagggtcactggaaatgaaccagtcactgaccagggcaatggagactgtattaatagcaatgatgatttgtacaatgccctgccttttttgaagcatttgcatgggcagtatctcacatcatctcatctgatatcacacaaagatgacattggttggtgtcctcagtcaaaagaacagctgcctggtccttgatagttgtttggtggaaattctgtcacagtcagaagcatcggatccagcatcactgtcatccctatatttttattaggttctatcttgtagactcaaaaaatgtgaacattccagggtccttgccttgaggaggtttgcagcctggttcagttcagtccaatcacagaattaggcagccggggtcagaggatcagagaagggaaggggtcaccaggtcccaggtggtggaggaagactccgtggagtgaacttgttaggagcctgaaagcagacattcaggcatcagagagggtaggagggccctggggccatcccactgtccaccagaacaaaggctgccctggcatcagactcactccagacctgttccagaatgccagggattgaactcagagcccatgccaaggcatgatggtgaacagacagtgtgagtgtggtgacaagccactaaactccagggacctgaggccagttgctggtcactcaaaactcatgtcatttacagagtggttccatcactctgttgttggataagcctctttctgttgcctgggggttggcagattgccgagaccagcttggtcatggagaccctaacccagtggtgctagaggaattaaagacacacacatagaaatatagagtgtggagtgggaaatcaggggactcacagacttcagagctgagagccctgaacggagtttgacccacatatttattgacagcaagccagtgataagcattgtttctatagattatagataaactaaaagtattccttacaggaaacaaagggatgggccgaaacaaagggatgggctctggctagttatctgcagcaggaacatgtccttaaagcacagatagctcatactattatttgtggcttaggaatgctttaagcggttttccaccctgggtgggccaggtgttccttgcccttattctgataaacccacaaccttcagtttgggcatcatggccatcatgaacatgtcacagtactgcagagattttgtttatggccagttttggggccagtttatggccagatttgggggcctgttcccaacacgttcccctttttgttttccaaagtgataaaagcaaaggcagctttgtcatggtgagctaattctcacaggagtcaggatccgcacctgcagactatacaaagacaaacaacacagattaaaagcacaatcatcattgaaatcacagagcttccaagtgtctttatccactttaatgggttaatatctgctaatctgtctgcagctccttcaagcactccagttcctggcattaaggtcaagtgtgcctgggatgctttaaatatttgttcttttaattttgcaatatgcaaagacaagtttgtagagtgtccttctagatgcttttttattctttcccaaattttgatcttattaacagacattaatagtttccacaaatccttatgtttagcttctacagtggaccatatcatttgaggttgaggtgccactataccgccacgtttccagataatgggaactcttgctgtatttcttaccatttctaccatctgactgttttgtttagaccagctgaacatagtgtggctgtggcacacagactgagaggtgtaatttaagctaaacatccccttaggggaccaatcaataatgattccataggaatcgttgtgcagcacctctacctgttctgcaatgcaatcttcccaaacaagtacattcattatttctggccaggtctaattctatttacaaataggttttgagctgcctttgctttgcctcaattataggagcagatttattatggtaaatattaagagcagaaagcatgtgtaactgtgtcacacagtgattacatccaggcattattgccagccaagattgataaatatgcccaataagtataactgttctctgtgttgttccttgttgaaggaatactcatggcaatggtgatcaccactatcatatctatcattaaattactcattgtgactggttgtcccactttcctcaggttttcttccaccatctgtgacagcttcttgatctgtccccaggtaggtggctgtgttcgacagctgttgctcatgatagttggggtcctcctcagcatcagtcttgacatggctgcaaccaggggatcctcgggatcctcctggaatctcttcctcagcatctggctcgtggcaaggtttcaggtgtcttgatggcacccaaattggctattgattcggtcctggagaaacacaagcataacctctaccccaagttattattttacctatttcccaactttttgttattgtatctctccaccaaaccagttgttctgcttctgtctttgcagctggtttctgtagatgctgttcagctgctggcctttaagcaggctcaaaaaatttaaagtcaataatgctagaatcaattgcatatggggtgtcccgtagtccctgcttctccccttttgcttttgcaactgctgtttcagggagagattcattctttctactatggcttgtccttgagaattatatgggatgccagtaatgtgtttaatattccatatagagaaaaatgtagctagagcttggctagtacagcctggggcattatctgttttaatagaagctggaatgcccatcaccgcaaaacactgcaaaaggtgacgtttaacacaggcagaagactctcctgattggcatgtagcccagacaaagtgagaaaaggtgtccacacatacatgtacataagctagtctcccaaacgagggaacatgtgtgacatccatttgccaaagagaattaggttccaatccttgaggattaactcctcctgtaaaagatgaggaatgcaccatttggcaagttgggcatcgctggataatagctttagcttctttccaggtaatgccgtatctgtgtttgagaccagaggcattaacataggttaaattgtgaaagtgtctagcgttagatattgcattagcaactaggtgatcagccatttgattcccttcagttaaaggtcctggaagaggtgtatgagccctaatgtgagtgatgtaaaaaggatgcattctactcctgactgctgtttgcaattgggtaaataaagccatcagttgctcatctgtgtggaatcgtagttgagcattttcaattaattgtgtggaatgaatcatgtatgaagaatcagaaatcacattgataggcctattaaaagcagtcaatacctcaattacagctataagctctgctttttgaactgaagtatagggcatctgaagcccttacttttcaagccagagttagaagctttaccattactagacccatctgtgaagacattttcagcaccttcaagtggtttgaatttagttattttagggagaatccaattagttaatttcaaaaattgaaacaattttgttttgggaaaatgattatcaagaatacccacaaagtcagctaaatgggtttgccaggtaagactatttataaaagcttgctctatttgtgccttcatgagaaggacaataatttttccaggaccatatccatgtaatttaacaatctgagttctcccatttcctatcatagtagcgatttgatccaaataaggagttagagtccgtgaattagtatgtggaagaaaaagccgctctacaagatcttgctcttgaacaataacaccagtaggtgaatgccgagttgaaaaaattagcaaatctagagtcttttctggatctattatatttatttgagctttatggacttgctttttgatgagctgcagctctgcatcagcttcttttgttaattgccgagggctatgagactagcatctcctctaaggttagaaaatggcataggtaggaatgcctagagtaggtcatatccaattaatgtcccctggtaatttttgaaagtcatttaatgttttcagttgatccctacatatggttactttctgtggcacaatgatagtgtcatttactgaagtctccaagtaggagtaaggagtagcagtctgaattttgtcaggagctataattaaaccagcatgagaaatcaaattttgcaagtgatcataacattggagtaatatttctcgagtggggggcagcacaaagtatatcgtccatataatgaataatgtaacactgtgaaaattttttatgagtaggttcaattgtttgccctacataagtctggcaaattgttggactgtttaacatgccttgtggcaacagtttccagtgaaaatgcttagcaggctgcaggttgtttactgcaggaattgtaaatgcaaaccattcacagtcctgctcagctaaggggatagtaaagaaacagtcttttaaatctatgactattaaaggccaattctttggaatcatagcaggagaaggcagtcctggctgcaatgtccccataggttgtataactgaattaatggctcttaagtcagttaacagtctccatgtacctgattttttcttaattataaaaactggagagttccaaggggaaaatgttggagctatgtgtcctttttctaattgttcagtaactaagtcctctgagcctccagtttctctttacttagcagtcattgttctatccaaattggctcatctgttaaccattttaaaggtataggttctggaagcttaacaatggctgccatcaaaaatgatatcctaaaccttggcaggaactttgtctttccgcttgaagtggttccttcaaatcttgcaaattttttcctagtcccataccagggacataccccatttcatgcaccatacgttgactttgagggctatacaattgctctagaattagaacttgtgctatccattgttgtaacaaatctctttcccataaatgtataggtacagaagttataattggttgaatagtcccatgttgtccatcgggcccctcacaatgcaaaatataattactttgatatacttcaggggctttaccaactccaactatgttaaattgagtgggttgaatttgccacgtggacagccagtgctgtagagaaatgattgaaatgtctgctcctgtatctaccaaacctttaaatttctttccctgaatagttatttcacaggtaggatgtttatcagtaatttgattcacccaataagctgctttgtcttgtttatttgtgcttccaaattctcctattcgtttaatttcacttttccccatttccacatacggcacaatcagaagttgtgctatacgctttcctggctctgctttccaaggaaaagaagtaaatataacaatttgaatttccccattgtaatctgaatcaatgactcctgtatgtacttgcactccttttaaatttaaactagatctacctagaagtaatcctatcatccccccggcaagcatccacagacccctattggaactttttgtggggattccccaagcataaggctcacagcttttgtgcagtataaatctactgtggcactactggctgtcgtgggggacagacattgtacaggggtgagggagtgagctataatatttccctgttgatctggggggtatatcctaacagggaactgccaagcctctatatcaccctctcgtctagctggctcaattcctgcctgaatagaactgagagcagtcactcgaggcactgctagaacagtcactggggcaactacttttcacccagtgtcctctggaaaagaaagatctgtagggtcaggtcactctttttcttcaaaataatgagggggtgaagaagagtagggacaaacctcttcctcatttgccgctttagcttcagccagcaaacaaacctgctgtgtcatctcttctgttactttgttatactttccttccttctcatcattagtgtgaaaaggttctaaggtggaacgcaccagagcccacacttgtcccattgttaccctgatgtttccgagctccccttcttactcaccatggggattgcttaagggtactcgggtgtcctccagcttagttccacattctccaaccatcactccagcgacccttcaactggggttcaagccccacgttgggcgccacttgccgacaccagctcggtcttggagaccctaacccagcggcgctagaggaattaaagacacacacacagaaatatagagtgtggagtgggaaatcaggggactcacagccttcagagctgaaagccccgaacagagtttgactcacatgtttattgacagcaagccagtgataagcattgtttctaaagattatagattaactaaaagtattccttatgggaaacaaagggatggactgaaacaaagggatgggctctggctagttatctgccacgtccttaaggcacagctcgctcatgctattgtttgtggcttaggaacaccttaagaggttttcccccctgggtgggacaggtgttccttgccctcattccagtaaatccacaaccttcagtgtgtgcatcatggccatcatgaacatgtcacagtgctgcagagattttatttatggccagtttatggccagatttgggggcctgttcccaacagcagattctatgaccacttcagccctgcctttacagtttctgtttacctgtaaactttttcttcctgtggcctagggtagttcaggatcactaaaaatgtgttctgtgatatattaataaaaattcctgaaaaatggacttacagcaaaa

SEQ ID NO: 111462 - DNA, 1819 bp, Homo sapiens
  Payload ID: 1826
  Gene Symbol: B4GALNT2
  Gene Name: beta-1,4-N-acetyl-galactosaminyl transferase 2
  Uniprot ID: Q8NHY0
  ENST ID: ENST00000504681
  CDS Start-End: 116-1558
aaggccgcgaggttggagggcacggggacacagcatagcgaggaaggaacgctcgagatttctgtggctcctcaagatattggtcataatcctggtacttggcattgttggatttatgttcggaagcatgttccttcaagcagtgttcagcagccccaagccagaactcccaagtcctgccccgggtgtccagaagctgaagcttctgcctgaggaacgtctcaggaacctcttttcctacgatggaatctggctgttcccgaaaaatcagtgcaaatgtgaagccaacaaagagcagggaggttacaactttcaggatgcctatggccagagcgacctcccagcggtgaaagcgaggagacaggctgaatttgaacactttcagaggagagaagggctgccccgcccactgcccctgctggtccagcccaacctcccctttgggtacccagtccacggagtggaggtgatgcccctgcacacggttcccatcccaggcctccagtttgaaggacccgatgcccccgtctatgaggtcaccctgacagcttctctggggacactgaacacccttgctgatgtcccagacagtgtggtgcagggcagaggccagaagcagctgatcatttctaccagtgaccggaagctgttgaagttcattcttcagcacgtgacatacaccagcacggggtaccagcaccagaaggtagacatagtgagtctggagtccaggtcctcagtggccaagtttccagtgaccatccgccatcctgtcatacccaagctatacgaccctggaccagagaggaagctcagaaacctggttaccattgctaccaagactttcctccgcccccacaagctcatgatcatgctccggagtattcgagagtattacccagacttgaccgtaatagtggctgatgacagccagaagcccctggaaattaaagacaatcacgtggagtattacactatgccctttgggaagggttggtttgctggtaggaacctggccatatctcaggtcaccaccaaatacgttctctgggtggacgatgattttctcttcaacgaggagaccaagattgaggtgctggtggatgtcctggagaaaacagaactggacgtggtaggcggcagtgtgctgggaaatgtgttccagtttaagttgttgctggaacagagtgagaatggggcctgccttcacaagaggatgggatttttccaacccctggatggcttccccagctgcgtggtgaccagtggcgtggtcaacttcttcctggcccacacggagcgactccaaagagttggctttgatccccgcctgcaacgagtggctcactcagaattcttcattgatgggctagggaccctactcgtggggtcatgcccagaagtgattataggtcaccagtctcggtctccagtggtggactcagaactggctgccctagagaagacctacaatacataccggtccaacaccctcacccgggtccagttcaagctggccctccactacttcaagaaccatctccaatgtgccgcataaaggtgtgagggcataggagaaacactaggctggctggttatggtatctatagcaggccaccaaaaactggactcctgataggtgaacgttgtaccaaaccagctggtgggtagggaaaagggaaatggctcagttactggaagtaccaatcaaaggtgaagggtcactggaaatgaaccagtcactgaccagggcaatggagactgtattaatagcaatgatgatttgtacaatgccctgccttttttgaagcatttgcat

SEQ ID NO: 111463 - DNA, 5068 bp, Homo sapiens
  Payload ID: 1827
  Gene Symbol: B4GALNT3
  Gene Name: beta-1,4-N-acetyl-galactosaminyl transferase 3
  Uniprot ID: Q6L9W6
  ENST ID: ENST00000266383
  CDS Start-End: 14-3010
tcggcgcagcgccatggggagcccccgggccgcgcggcccccgctgctcctgcgcccggtgaagctgctgcggaggcgcttccggctgctgctggcgctcgccgtggtgtctgtggggctctggactctgtatctggaactggtggcgtcggcccaggtcggcgggaaccccctgaaccggaggtacggcagctggagagaactggccaaggctctggccagcaggaacattccagctgtggatccacacctccagttctaccatccccagaggctgagcctcgaggaccacgacattgaccaaggggtgagcagtaacagcagctacttgaagtggaacaagcctgtcccctggctctcagagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaagattgaccagcctgagaagcaggggctggagcagccaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccgggggaggtaccagctacagcgcattgtgaacgtggaaaagcgtcaggaccagctacgtgggggtcgctacctcctggagcttgaactgttggaacaaggccagcgcgtggtgcggctctcggagtatgtgtctgcacgaggctggcagggcatcgatccagctggtggggaggaggtcgaggcccggaacctgcaaggcctggtctgggacccacacaaccgtaggagacaggtcctgaatacccgggcccaagagcccaagctgtgctggcctcagggtttctcctggagtcaccgagccgtggtccacttcgtcgtgcctgtgaagaaccaggcacgctgggtacagcaattcatcaaagacatggaaaacctgttccaggtcaccggtgacccacacttcaacatcgtcatcactgactatagcagtgaggacatggatgttgagatggcactgaagaggtccaagctgcggagctaccagtacgtgaagctaagtggaaactttgaacgctcagctggacttcaggctggcatagacctcgtgaaggacccgcacagcatcatcttcctctgtgacctccacatccacttcccagctggagtcatcgatgccattcggaagcactgtgtggagggaaagatggcctttgcccccatggtgatgaggctgcattgtggggccaccccccagtggcctgagggctactgggaggtgaatgggttcgggctgcttggcatctacaagtctgacctggacaggattgggggcatgaacaccaaggagttccgagaccgctggggcggggaagactgggagctgctggacaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggccctgctactgttcagggatggggagtggggtgacggctggaccccaagaggcctcgaagctgacggcccactccacctggagctgtcccctcacagaggcaggttccggggctcctgtctctgcctcctgggccttcagaagggaggactttgagagagaggccaggagggaccacttgctcagtcgagaacgggaagagctcctgagaaggacgggtcaggaaggagagatctgactgagcgacaccatcctcatccatgaaggtgcacgcccacatcccccaagcgctcctcacgccaagcgctgaccaccagaccctcttctagtggacatattttattggggggcggggattttaaaaacagaaaaccgaaactgctgtccagagcgggggtgaggttgtgcactgagggactgtccccacgtgcaggcctcccgcccactcctatgtcccttgggcgttgtccctggccgcgggactggtcccacgtggggcaggtctctgctccaccccaggctcgtgccttccagagacacacatctcccagtagccaccaaacagctggccactgattagggcattaacttcctccggatggctcacgtcagaccagaagcacagaacgggctgtttctggtgcttgggcattgggaggtggggagctggcgggcagggggcttgccactccctggcactggacattgaggcctgcagaacaggcagggtgatgaaggcaggggagagaagccctttcccttaccggcgtgcctgtgggtaaggcctcccgagaggacatggagaagaggtaaagaggatgtggacatatctgtcaatttccttaggcaagaagcgggtgggggctggacagaaagggacgaaaagggaagtggaagctgtgagcctcacagtccagctccactgcagacctgcccttctgcagggagagccctggccacccggccttgagtggaagaagaggaaagggtgtacgggggcaaaaccctggacagggagcaggataagaagggggcgggatgagaggtttggggaggtgaggacattgccctgagatatcccctggaggcagggagaggagtgggggcaggaggaactgaagaggggggcagtttcagggaaaatagcccttagcctttttagtcgatgccaccctttctgtcacctggagaccttgtacttctcttgcactaataaccccggtgcttttgtggctgggggtttttctgttgctgctgctgcctccaccactgctgtgaattcacccatggtgcattggacactggatcttgaactccagagtctgtttagggaggtgagcacagggctgggggaggtgcggcggggcccagaagaccaggccactgagcccgcgctccaggctgtgacggtccaaaccacggcactggagctgcagggtctgcctagtgggctctgcattccccgagagcacgagtttggcacatgggagaatggagcccgtggagaaccttctggggggtcggggagaatccctgcctccctttaaggaatcatgaaggacagagacttttgagattgtggcttaggaaggccatacctgctccctgggctgtggctttttctggtccctgctgaggccgactggcccctggagaaggatggtggggcataggctagggctgcagttggccagtggggctgccagtttctttctgggaccactctcgtcctcgggcattgcactggaaggctggaaccagcccaaactgcccacctgcttcacttccaatgactaggagccagcccagcctcctgccctgcccacacccctgcgccctgggccagtgccttgcgtttgatgttacctccacaccatctgccttaagaggaagggccgggcaaggcccctactccctagagaaatgtcttgggtaggagagggtgtgggatggtgggaggggaagcattaaatacagcaacttcttagaaaaaaaaaaa

SEQ ID NO: 111464 - DNA, 1926 bp, Homo sapiens
  Payload ID: 1827
  Gene Symbol: B4GALNT3
  Gene Name: beta-1,4-N-acetyl-galactosaminyl transferase 3
  ENST ID: ENST00000322843
  CDS Start-End: 17-1926
atgtgtgtgtgtgtgcatggccagagcagaccttgtccccaaggccaggccatggggtgaacatcagcaccagttccggggccgtgccaacctgcatgtgtttgaagactggtgtggcagctctatccagcagctcaggaggaacctgcatttcccactgtacccccatattcgcacaaccctgaggaagcttgctgtgtcccccaaatggaccaactatggcctccgcatctttggctacctgcacccctttactgatgggaaaatccagtttgccattgctgcagatgacaacgcggagttctggctgagcctcgatgaccaggtctcaggcctccagctgctggccagtgtgggcaagactggaaaggagtggaccgccccgggagagtttgggaaatttcggagccaaatttccaagccggtgagcctgtcagcctcccacaggtactacttcgaggtgctgcacaagcagaatgaggagggcaccgaccacgtggaagttgcatggcgacggaacgaccctggagccaagttcaccatcattgactccctctccctgtccctcttcacaaatgagacgttcctacagatggatgaggtgggccacatcccacagacagcagccagccacgtggactcctccaacgctcttcccagggatgagcagccgcccgctgacatgcttcggcctgacccccgggacaccctctatcgagtgcctctgatccccaagtcgcatctccgccacgtcctgcctgactgtccctacaaacccagctatctggtggatgggcttcctctgcagcgctaccagggactccggtttgttcatctgtcttttgtttaccccaatgactatacccgcctgagccacatggagacccacaataaatgtttctaccaggaaaacgcctactaccaagaccggttcagctttcaggagtacatcaagattgaccagcctgagaagcaggggctggagcagccagcaggttttgaggaaaaccttctagaagagtcccagtatggggaagtggcagaggagacccctgcctccaacaaccagaatgccaggatgcttgagggaagacagacacctgcctccaccctggagcaagatgccactgactaccgcctccgaagcctgcggaaactcctggctcagccccgggagggcctgctggcccccttctccaagcggaactccacagcgtccttcccagggaggaccagccacattccagtgcagcagccagagaagaggaagcaaaaacccagccctgagcccagccaagattcacctcattccgacaagtggcctcctgggcaccctgtgaagaacctgcctcagatgagggggcccaggcccaggcccgctggtgacagccccaggaagactcagtggctgaaccaggtggagtcgtacatcgcagagcagagacggggtgacaggatgcggcctcaggcccctggaaggggctggcatggggaggaggaagtggtggcggccgcaggccaggaaggacaagtggagggagaggaagagggggaagaagaggaggaggaagaggatatgagtgaggtgttcgagtacgtacctgtgtttgacccggtagtaaactgggaccagaccttcagtgcccggaatctcgacttccaagccctgaggactgactggatcgatctgagctgtaacacatctggcaacctgctgcttccagagcaggaagctctggaggtcacgcgagtcttcttgaagaagctcaaccagaggagccggggctctgtggattttcctattccggacatcttatgcaaatggaaccatgtaatgtgtggcctttatatcgggctttttgcagaatattcacttagcacaagtttcattcgtgttgtagaatctattaaacacttcattcctcg

SEQ ID NO: 111465 - DNA, 3444 bp, Homo sapiens
  Payload ID: 1828
  Gene Symbol: B4GALNT4
  Gene Name: beta-1,4-N-acetyl-galactosaminyl transferase 4
  Uniprot ID: Q76KP1
  ENST ID: ENST00000329962
  CDS Start-End: 1-3120
atgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgcgccatccacacagagggctgaggactccagtgagagccgtgaagaggagcaagcgcccgaaggtcgggacctagacatgctgtttcctgggggggctgggaggctgccactgaacttcacccatcagacacccccatggcgggaggagtacaaggggcaggtgaacctgcacgtgtttgaggactggtgtgggggcgccgtgggccacctgaggaggaacctgcacttcccgctgttccctcatacgcgcaccaccgtgaagaagttggccgtgtcccccaagtggaagaactatggactccgtatttttggtttcatccacccggcgagggacggagacgtccagttttctgtggcctcagacgacaactcggagttctggctgagtctggacgagagccctgctgctgcccagcttgtggcctttgtgggcaagactggctccgagtggacagcgcctggagaattcaccaagttcagctcccaggtgtccaagcccaggcggctcatggcctcccggaggtactactttgagttgctgcacaagcaggacgaccgcggctcggaccacgtggaagtgggctggcgagctttcctgcccggcctgaagttcgaggtcatcagctctgctcacatctccctgtacacagatgagtcagccttgaagatggaccacgtggcgcacgtcccccagtctccagccagccacgtgggggggcgtccgccgcaggaggagaccagcgcagacatgctgcggccagatcccagggatacctttttcctcactccacgcatggaatcttcgagcctggagaacgtgctggagccctgcgcctacgcccccacctacgtggtcaaggacttcccgatcgccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacaaggaggagggggatgaggatgaagaagacgaggtgcagcgccgagccttcctcttcctcaacccggacgacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggcgcttcgcgcttctgcgcatcgtgaacgtggagaagcgccgggactcggcgcgagggagtcgcttcctgctggagctggagctgcaggagcgcgggggcggccgcctgcgactgtccgagtacgtcttcctgcggctgccgggagcccgcgtaggggatgcagacggagaaagtcccgaacccgctcccgccgcctccgtgcgccccgacggccgccccgagctctgccggccactgcgcctggcctggcgccaggacgtgatggttcacttcatcgtgccagtgaaaaaccaggcacggtgggtggcacagttcctggcggacatggctgcgctgcacgcgcgcaccggggactcgcgtttcagcgtcgtcctggtggatttcgagagcgaggatatggacgtggagcgggccctgcgcgccgcgcgcctgccccggtaccagtacctgagacgaaccgggaacttcgagcgctccgccgggctgcaggcgggagtggacgcggtagaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggttactgggaggtgaacggctttggcctttttgggatctacaagtcggactttgaccgggttggaggaatgaacacggaggagttccgagaccagtgggggggtgaagactgggagctcctggacagggtcctgcaggcagggctggaggtggagcggctccgactgcggaatttctatcaccactaccactccaagaggggcatgtggagcgtccgcagcaggaagggctctcgcacgggggcgtcttgaggacgggcagcccctcccagccccggtgggagtcccgaggcagctgctgggggctgggctttgagctcggtcccgagagacccggcagggctggtcagaggggcacagccaccgcctgtgcctgcccctctctggcccactgggcgtcgtgcccctccccggagaggcagccttcacggcgggtcagggcctggccttggtccccactctgcgatgatttctgtgaaattttgctgtagcgatgacattgttttcagaatttccaagagttctgtctgttctgttttttattcagaatgaaatgaaatattttttttagttctg

SEQ ID NO: 111466 - DNA, 876 bp, Homo sapiens
  Payload ID: 1828
  Gene Symbol: B4GALNT4
  Gene Name: beta-1,4-N-acetyl-galactosaminyl transferase 4
  ENST ID: ENST00000534778
  CDS Start-End: 1-162
gacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacgggtcatgacccagtaccaccggacgactcccggaagcccccgtggtgatgggacccggcacctgacccctcccgaggtctcctagcggcgctttgccggggggaccttgcaggacctggtctgaagggtagcacccctcaccctcccgccccaggttactgggaggtgaacggctttggcctttttgggatctacaagtcggactttgaccgggttggaggaatgaacacggaggagttccgagaccagtgggggggtgaagactgggagctcctggacagggtcctgcaggcagggctggaggtggagcggctccgactgcggaatttctatcaccactaccactccaagaggggcatgtggagcgtccgcagcaggaagggctctcgcacgggggcgtcttgaggacgggcagcccctcccagccccggtgggagtcccgaggcagctgctgggggctgggctttgagctcggtcccgagagacccggcagggctggtcagaggggcacagccaccgcctgtgcctgcccctctctggcccactgggcgtcgtgcccctccccggagaggcagccttcacggcgggtcagggcctggccttggtccccactctgcgatgatttctgtgaaattttgctgtagcgatgacattgttttcagaatttccaagagttctgtctgttctgttttttattcagaatgaaatgaaatatttttttt

SEQ ID NO: 111467 - DNA, 421 bp, Homo sapiens
  Payload ID: 1828
  Gene Symbol: B4GALNT4
  Gene Name: beta-1,4-N-acetyl-galactosaminyl transferase 4
  ENST ID: ENST00000526584
  CDS Start-End: 1-81
gacgtggagcgggccctgcgcgccgcgcgcctgccccgagatcgtgcctgtgactcgccctccccaggtaccagtacctgagacgaaccgggaacttcgagcgctccgccgggctgcaggcgggagtggacgcggtagaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggttactgggaggtgaacggctttggcctttttgggatctacaagtcggactttgaccgggttggaggaatgaacacggaggagttccgagaccagtgggggggtgaagactgggagctcctggacag

SEQ ID NO: 111468 - DNA, 732 bp, Homo sapiens
  Payload ID: 1829
  Gene Symbol: B2M
  Gene Name: beta-2-microglobulin
  ENST ID: ENST00000349264
  CDS Start-End: 31-204
attcctgaagctgacagcattcgggccgagatgtctcgctccgtggccttagctgtgctcgcgctactctctctttctggcctggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttata

SEQ ID NO: 111469 - DNA, 933 bp, Homo sapiens
  Payload ID: 1829
  Gene Symbol: B2M
  Gene Name: beta-2-microglobulin
  ENST ID: ENST00000544417
  CDS Start-End: 61-366
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 111470 - DNA, 1715 bp, Homo sapiens
  Payload ID: 1829
  Gene Symbol: B2M
  Gene Name: beta-2-microglobulin
  Uniprot ID: P61769
  ENST ID: ENST00000558401
  CDS Start-End: 71-430
gcacgcgtttaatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaaattttcaaggcatagttttatacctga

SEQ ID NO: 111471 - DNA, 407 bp, Homo sapiens
  Payload ID: 1829
  Gene Symbol: B2M
  Gene Name: beta-2-microglobulin
  ENST ID: ENST00000557901
  CDS Start-End: 29-184
tcctgaagctgacagcattcgggccgagatgtctcgctccgtggccttagctgtgctcgcgctactctctctttctggcctggaggctatccagcattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgca

SEQ ID NO: 111472 - DNA, 717 bp, Homo sapiens
  Payload ID: 1829
  Gene Symbol: B2M
  Gene Name: beta-2-microglobulin
  ENST ID: ENST00000561139
  CDS Start-End: 1-216
gggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttga

SEQ ID NO: 111473 - DNA, 604 bp, Homo sapiens
  Payload ID: 1829
  Gene Symbol: B2M
  Gene Name: beta-2-microglobulin
  Uniprot ID: P61769
  ENST ID: ENST00000561424
  CDS Start-End: 39-398
tggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaattgtttttgatccatggtttgctgaatccacagatgtggagcccctggatacggaaggcccgctgtactttgaatgacaaataacagatttaaaa

SEQ ID NO: 111474 - DNA, 1081 bp, Homo sapiens
  Payload ID: 1829
  Gene Symbol: B2M
  Gene Name: beta-2-microglobulin
  Uniprot ID: P61769
  ENST ID: ENST00000559916
  CDS Start-End: 35-394
gggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatat

SEQ ID NO: 111475 - DNA, 1715 bp, Homo sapiens
  Payload ID: 1829
  Gene Symbol: B2M
  Gene Name: beta-2-microglobulin
  Uniprot ID: P61769
  ENST ID: ENST00000617605
  CDS Start-End: 71-430
gcacgcgtttaatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctagcagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacagtcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggccagctgtactttgaatgacaaataacagatttaaaattttcaaggcatagttttatacctga

SEQ ID NO: 111476 - DNA, 933 bp, Homo sapiens
  Payload ID: 1829
  Gene Symbol: B2M
  Gene Name: beta-2-microglobulin
  ENST ID: ENST00000619603
  CDS Start-End: 61-366
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctagcagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 111477 - DNA, 407 bp, Homo sapiens; identical to SEQ ID NO: 111471
  Payload ID: 1829
  Gene Symbol: B2M
  Gene Name: beta-2-microglobulin
  ENST ID: ENST00000633158
  CDS Start-End: 29-184

SEQ ID NO: 111478 - DNA, 717 bp, Homo sapiens; identical to SEQ ID NO: 111472
  Payload ID: 1829
  Gene Symbol: B2M
  Gene Name: beta-2-microglobulin
  ENST ID: ENST00000631575
  CDS Start-End: 1-216

SEQ ID NO: 111479 - DNA, 604 bp, Homo sapiens
  Payload ID: 1829
  Gene Symbol: B2M
  Gene Name: beta-2-microglobulin
  Uniprot ID: P61769
  ENST ID: ENST00000631728
  CDS Start-End: 39-398
tggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaattgtttttgatccatggtttgctgaatccacagatgtggagcccctggatacggaaggccagctgtactttgaatgacaaataacagatttaaaa

SEQ ID NO: 111480 - DNA, 732 bp, Homo sapiens
  Payload ID: 1829
  Gene Symbol: B2M
  Gene Name: beta-2-microglobulin
  ENST ID: ENST00000632867
  CDS Start-End: 31-204
attcctgaagctgacagcattcgggccgagatgtctcgctccgtggccttagctgtgctcgcgctactctctctttctggcctggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctagcagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttata

SEQ ID NO: 111481 - DNA, 1081 bp, Homo sapiens; identical to SEQ ID NO: 111474
  Payload ID: 1829
  Gene Symbol: B2M
  Gene Name: beta-2-microglobulin
  Uniprot ID: P61769
  ENST ID: ENST00000631573
  CDS Start-End: 35-394

SEQ ID NO: 111482 - DNA, 2670 bp, Homo sapiens
  Payload ID: 1830
  Gene Symbol: BCO1
  Gene Name: beta-carotene oxygenase 1
  Uniprot ID: Q9HAY6
  ENST ID: ENST00000258168
  CDS Start-End: 462-2105
tcataaacaactccagctcttggattacgtcgggcaacataacagcaggcacggaattctctctgcttatttagaacctagtctgaagcaagcttttttttttttttggttaagtcaaaagtgaaactggagagggaaagctgagggaacaataagaggattaaagattagctatgacacatggcttggaaattaacctttaaccaaacatcttataagtaacgccagcgcagcttcccttgtgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacggtgaagtctattacaggagcaaatacctgagaagcgatacctacaacaccaatattgaggcaaacaggattgtggtgtctgagtttggaacaatggcctatccggacccctgcaaaaacatattttccaaagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgacaagggcatggcaagagagcttgtcagtatcatttctttcattttattttggctgtaaaaattttgtttgaaagtcaaacatttgaacatcaaatatgtattgattagatccagtccttctaagaaacctcctttcctttaacaaaaagaccttgaccatgaatcagagattgtattcaatgacattatcatcatttttagaacgagccactaacctattagagaagaggcagataattatttatcattgtgccttcctctgtctctttctctttcctttgctccctcccatgtttctggtggactaaattgtgtatctgggagttctcactttctagccaggcctgatgagttaagttacatgaccaggaaggttatgccactttgtggtcattccatgcaagtcatggcgtaatataaaataataaaaactttaaagtctg

SEQ ID NO: 111483 - DNA, 949 bp, Homo sapiens
  Payload ID: 1830
  Gene Symbol: BCO1
  Gene Name: beta-carotene oxygenase 1
  ENST ID: ENST00000564552
  CDS Start-End: 219-707
gaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacggtgaagtctattacaggagcaaatacctgagaagcgatacctacaacaccaatattgaggcaaacaggattgtggtgtctgagtttggaacaatggcctatccggacccctgcaaaaacatattttccaaagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggtatcaacacatatgtaaccagcatcacttcctgactcaagaaagggagagtcggcgacggccggggtgaggttgctcagcctgcaagcagcttaccaggggagcccctcctctaacaccgttggatcccgtgccctagcgccacacttactgctagatgctaggcagggactgtgttgtttttatcttcgtgtctgtatcagtttcctggggctgatgtaaccaagtcctacaaaaaagattgctttaaacaacagaaa

SEQ ID NO: 111484 - DNA, 1857 bp, Homo sapiens
  Payload ID: 1830
  Gene Symbol: BCO1
  Gene Name: beta-carotene oxygenase 1
  ENST ID: ENST00000563804
  CDS Start-End: 221-466
gtgaatgtaaagagatccagggctcttggagagggacaagtgagagccagccaaaaaggaaaaagcaaaggcagaaacggcatcaggagagacagagatgtgaaggagggaaggagcaggagagcaggaaggaaacgcaggaggagggagcagcatctcctgtgaacacagaggagcacctgtttgctgttaaaatcgatctccctcggcaccctgagcaatggatataatatttggcaggaataggaaagaacagctggagcctgtgagggccaaagtgacaggcaagattccagcatggctgcagggaaccctgctccgcaatgggcctgggatgcacacagttggggagtccagatacaaccattggttcgacggccttgccctgctccacagcttcaccatcagagacgagctttctcctacttgtctcacaccatccccgatttcaccgacaactgcctgatcaacatcatgaagtgcggagaagacttctacgcgacctcagagaccaattacatcaggaaaatcaacccacagactctggaaaccctggagaaggttgattatcgtaaatacgtggcggtaaatctggcaacgtcacatccccattatgatgaggctggaaatgttctaaacatgggcacatccattgtggaaaaggggaagacaaagtatgtgatttttaagatccctgccacagtaccagagggcaagaagcaggggaagagcccctggaagcacacagaggtgttctgctccatcccatcccgctccctgctctccccaagctactaccacagctttggagtcaccgagaactatgtcatcttccttgagcagcctttcaggttggatattctcaagatggcaaccgcatacatccggagaatgagctgggcctcctgcctggctttccacagggaggagaagacttatatccacatcatcgaccaaaggaccaggcagcctgtgcagaccaagttttacacagacgccatggtggtcttccatcacgtcaacgcctacgaagaggacggctgcatcgtgtttgacgtcattgcctacgaggacaacagcctctaccagctcttctacctggccaacctgaaccaggacttcaaggagaactccaggctcacctcggtccccaccctcaggaggtttgccgtgcccctccacgtggacaagaatgcagaagtgggcacaaatttaatcaaagtggcatctacaacagccacggccctgaaggaagaagatggccaagtctactgccagccggaatttctttatgaaggcttagagcttccacgggtcaattatgctcacaatggaaagcaataccgatatgtctttgctacaggagttcagtggagtccaatcccaaccaagataataaaatatgacattctcacaaagtcatccttaaaatggagagaggacgactgctggccagcggaacccctgtttgtgcccgcgccaggtgccaaggatgaggatgacggagtaatcttatcagccattgtctctactgatccccaaaagctgccttttctgctcattctggatgccaaaagctttacggaattggcccgtgcctctgttgatgtcgatatgcacatggatctccatggattattcattacagacatggactgggacacaaaaaagcaggccgcttctgaggaacagcgggacagggcttccgactgccacggggctcctctgacctgatggtgttggggtttgggtaggggaggggagctcggctgtcagaactccatggatatgtttctttggatggaggggagggcctttgttaccttttgcacttattctttctgtgggtgctttgac

SEQ ID NO: 111485 - DNA, 2930 bp, Homo sapiens
  Payload ID: 1831
  Gene Symbol: BCO2
  Gene Name: beta-carotene oxygenase 2
  Uniprot ID: Q9BYV7
  ENST ID: ENST00000357685
  CDS Start-End: 136-1875
aagctgcgtcctctctttgacctgtcagtgagggagggacagtccaggcagttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaatgtactctatacaaaagacagagcataaagggcaccgtacctcccaaaccaatgtcccaaatagacatttagtttaaaaatttctgttaaaaacagaattcactatttccttgccactgccaagtcacgccatggcagaggctcgagtgcatacaagcttcggttttacccttaatacaccatcatgaccaatggaggcattgctgctggaggtgtcatggccattaacactactttataagaggtgcggaagactgccctcactcatcatggcctagcatgtgcaatttgtgaagctgccaaagcgttagacaagcaccaagcccacttttgtctgcctgcacccaactgcaatgagcctatgtatgtcaagttggtggagtcccatggtgctgaacaccaactcaccctaattaaggttgatgacaacaagaaaccagaggaatgggtaggcctctgtaaaactgagagggaaacccccgaaaagtggttggctgcagttgtgcagtagttaaggactaggtcaaagaatcttaagtcaaggatgtcatcgaagagtatttcaaatgtaagaaatgaacaaataaaactttggcactcatgtttcttaagaaaaaacaccacaaagcagaattcataatataactatggttatagatatttattttttagggctcttacttgaaataattaagaaagtattgatacaaccttttgaagagggttttaaatttcatttattggatatatcttcctctaggtaataataagaatacacgaaataaaaa

SEQ ID NO: 111486 - DNA, 1868 bp, Homo sapiens
  Payload ID: 1831
  Gene Symbol: BCO2
  Gene Name: beta-carotene oxygenase 2
  Uniprot ID: Q9BYV7
  ENST ID: ENST00000361053
  CDS Start-End: 81-1601
gtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaacaaagaa

SEQ ID NO: 111487 - DNA, 2598 bp, Homo sapiens
  Payload ID: 1831
  Gene Symbol: BCO2
  Gene Name: beta-carotene oxygenase 2
  Uniprot ID: Q9BYV7
  ENST ID: ENST00000438022
  CDS Start-End: 718-2355
gcctctttcctgaaggttgctgggagcttctgaagctttgtgtcctgtgtggctcagatgagatagcaattccgcagagtcctggaagttaaagaaggctgagttaggattgtttcctcatggtcagggaaacagccttcacatttgtatattttatgcaatatttaaggcaggattcagggacttggtattctttgggatttgcaataagaagaatattcaatatttaggcttttctaaattgaaaaatcactgccacacgttctaatgtaattgtttggtttctctatttgcattttgcggggactgccttaaaactcatttatgttttatagccttctattatagttaccattgttacatgattttatgtatagaaattggctgatctagagctttcagaaatcatactaatatgcactataaattttaaaattacttaatgtagtaatttaatgtttgcagtatgcaagggaatgtattacgtactggaaggagagaggagacaaacaccagaccctgtactcaaggagtactggtagtatcatttatcatacaagacagataagataaggtccatatgagagctataaacagatgctgtgagttcagactaaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaat

SEQ ID NO: 111488 - DNA, 1647 bp, Homo sapiens
  Payload ID: 1831
  Gene Symbol: BCO2
  Gene Name: beta-carotene oxygenase 2
  Uniprot ID: Q9BYV7
  ENST ID: ENST00000532593
  CDS Start-End: 107-1531
agaatcagttcttgctgtaggtaaggggaatgctgtgtttataaagcaaatgacatggcaactggatcttgaaggatgagttaggtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcagg

SEQ ID NO: 111489 - DNA, 588 bp, Homo sapiens
  Payload ID: 1831
  Gene Symbol: BCO2
  Gene Name: beta-carotene oxygenase 2
  ENST ID: ENST00000525175
  CDS Start-End: 1-215
tgaaacaggctgatggaacgatctggtgctctcatgaaaatctacatcaggaggacctagaaaaggaaggaggcattgaatttcctcagatctactatgatcgattcagtggcaaaaagtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataa

SEQ ID NO: 111490 - DNA, 817 bp, Homo sapiens
  Payload ID: 1831
  Gene Symbol: BCO2
  Gene Name: beta-carotene oxygenase 2
  ENST ID: ENST00000530677
  CDS Start-End: 1-817
gtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctgccatgactgacaatactaatgtcaactatgtgcggtacaagggtgattactacctctgcactgagaccaactttatgaataaagtggacattgaaactctggaaaaaacagaaaagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaag

SEQ ID NO: 111491 - DNA, 569 bp, Homo sapiens
  Payload ID: 1831
  Gene Symbol: BCO2
  Gene Name: beta-carotene oxygenase 2
  ENST ID: ENST00000534550
  CDS Start-End: 87-239
agttctgtgcgtgttcactgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccaggtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaa

SEQ ID NO: 111492 - DNA, 494 bp, Homo sapiens
  Payload ID: 1831
  Gene Symbol: BCO2
  Gene Name: beta-carotene oxygenase 2
  ENST ID: ENST00000531003
  CDS Start-End: 71-367
actgtttagtagtactcaaaactgccagtgtgagaggatttggaaatcactggatctgctcaatacaaaaatgttttttcgagtctttctccattttatcaggagtcattctgccactgcagtggatttccttcctgtgatggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtaagccttgattttggagaacaacttggatttcttggcatgggctggttctgtggaatatgcattaatatctgcttcctctgtgaggtacaatcattggtttgatgggatggcgctgcttcaccagttca

SEQ ID NO: 111493 - DNA, 1983 bp, Homo sapiens
  Payload ID: 1831
  Gene Symbol: BCO2
  Gene Name: beta-carotene oxygenase 2
  Uniprot ID: Q9BYV7
  ENST ID: ENST00000526088
  CDS Start-End: 103-1722
aaggagaatcagttcttgctgtaggtaaggggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggtctggaaactaggtttaaaataagtgtgcacttggacataaagactggagaaataaacactgaggactccaaaaggggggcaaggaggaagaggggcaggggttaaaaagctacctattgaatactatgttccctatttgggtgatgggttcgttagaagtccaaacctcagcagcacacaatatactcatgtaacaagcctgcacatgtaccccagaatctaaaataaaaataaaaagaaaaac

SEQ ID NO: 111494 - DNA, 877 bp, Homo sapiens
  Payload ID: 1831
  Gene Symbol: BCO2
  Gene Name: beta-carotene oxygenase 2
  ENST ID: ENST00000527939
  CDS Start-End: 57-209
ctcaaaactgccagtgtgagaggatttggaaatcactggatctgctcaatacaaaaatgttttttcgagtctttctccattttatcaggagtcattctgccactgcagtggatttccttcctgtgatggtgcaccggctcccaggtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacag

SEQ ID NO: 111495 - DNA, 2493 bp, Homo sapiens
  Payload ID: 1831
  Gene Symbol: BCO2
  Gene Name: beta-carotene oxygenase 2
  Uniprot ID: Q9BYV7
  ENST ID: ENST00000531169
  CDS Start-End: 74-1711
gggaatgctgtgtttataaagcaaatgacatggcaactggatcttgaaggatgagttagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcagccatgactgacaatactaatgtcaactatgtgcggtacaagggtgattactacctctgcactgagaccaactttatgaataaagtggacattgaaactctggaaaaaacagaaaaggtagattggagcaaatttattgctgtgaatggagcaactgcacatcctcattatgacctggatggaacagcatacaatatggggaactcctttgggccatatggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaaattgccacttctaaaattcggggaaaggccttttcagatgggataagctgggaaccccagtgtaatacgcggtttcatgtggtggaaaaacgcactggacagctccttccagggagatactacagcaaaccttttgttacatttcatcaaatcaatgcctttgaggaccagggctgtgttataattgatttgtgctgtcaagataatggaagaaccctagaagtttaccagttacagaatctcaggaaggctggggaagggcttgatcaggtccataattcagcagccaaatctttccctcgaaggtttgttttgcctttaaatgtcagtttgaatgcccctgagggagacaacctgagtccattgtcctatacttcagccagtgctgtgaaacaggctgatggaacgatctggtgctctcatgaaaatctacatcaggaggacctagaaaaggaaggaggcattgaatttcctcagatctactatgatcgattcagtggcaaaaagtatcatttcttttatggctgtggctttcggcatttagtgggggattctctgatcaaggttgatgtggtgaataagacactgaaggtttggagagaagatggcttttatccctcagaacctgtttttgttccagcaccaggaaccaatgaagaagatggtggggttattctttctgtggtgatcactcccaaccagaatgaaagcaattttatcctagttttggatgccaagaactttgaagagctgggccgagcagaggtacctgtgcagatgccttatgggttccatggtaccttcatacccatctgatgggacaaccacaaggaaacttttccaagcctgttattaatcagtgacttgtcctgcttttcatcatatacagtgatgatttttctcatatagagtggagctgtcctctccagtacctggaacaatgccagccacatagtagatgcccaataaatatttagtgaaagagtgaatggaagcaagaggtgacatgattctgggaactgtgtgtagtttggttactcttgtgagtagatgtgaggaaacaagatcctttcactctcaatgtgtctacactggcagaagaattgctaatatgtgtttaggggtgtctgtattcacactatgccaacccagagtaataaatgggtccatacatgcttgtggataagaatggctttagaatttcccttagtaaggatcattacacaacagtccaaaggactgttgtcacgtggtcctatttgtgctctcaaattcttgctctttaaaaatttttttttaaagaaacggtattaatcctaagcaaaaagaacaaagctggaggcatcacgctacctgacttcgaactatactacaagcctacagtaacaaaaacagcatggtatgggtaccaaaacagatatatacaccaatggaacacaacagaggcctcagaaataacaccacacatctacaaccatctgatcttagacaaacctgataaaaacaagaaatggggaaaggattccctattaaataaatggtgctgggaaaactggctagccatatgtagaaagctgaaactggatcccttccttaca

SEQ ID NO: 111496 - DNA, 635 bp, Homo sapiens
  Payload ID: 1831
  Gene Symbol: BCO2
  Gene Name: beta-carotene oxygenase 2
  ENST ID: ENST00000532612
  CDS Start-End: 1-635
tggtgcaccggctcccagttttcaaaaggtacatgggaaatactcctcagaaaaaagccgtctttgggcagtgtcggggtctgccatgtgttgcaccgctgctgaccacagtggaagaggctccacggggcatctctgctcgagtctggggacattttcctaagtggctcaatggctctctacttcgaattggacctgggaaattcgagtttgggaaggataagtacaatcattggtttgatgggatggcgctgcttcaccagttcagaatggcaaagggcacagtgacatacaggagcaagtttctacagagtgatacatataaggccaacagtgctaaaaaccgaattgtgatctcagaatttggcacactggctctcccggatccatgcaagaatgtttttgaacgtttcatgtccaggtttgagctgcctggtaaagctgcaggtttctcctataaggttattcgggttcctccagagaaggtggaccttggggagacaatccatggagtccaggtgatatgttctattgcttctacagagaaagggaaaccttcttactaccatagctttggaatgacaaggaactatataattttcattgaacaacctctaaagatgaacctgtggaaa

SEQ ID NO: 111497 - DNA, 2816 bp, Homo sapiens
  Payload ID: 1832
  Gene Symbol: BTC
  Gene Name: betacellulin
  Uniprot ID: P35070
  ENST ID: ENST00000395743
  CDS Start-End: 362-898
ctggtccgagggcagcccgaatatgtccctgggtgtgggtatgggtgtggggcaatttgggtgggagcagcgtggaggctcccaggaccaagtcctgcgcctctttggcggggtgtgtgcaggaggaggggggataaataggaggctccctcctcccggcgacattcacggagccggccggcctcccgccctgggtgtttccctgccttgtagccagggtgccagcctgggaagtagtttcgtttccttctgcctccgggattagtttccaggcaccctctcaggcgcccgaggcccgggaagggggcgaagaaggagggagacttgtctaggggctgcccggcccggcagagcggggttgatggaccgggccgcccggtgcagcggcgccagctccctgccactgctcctggcccttgccctgggtctagtgatccttcactgtgtggtggcagatgggaattccaccagaagtcctgaaactaatggcctcctctgtggagaccctgaggaaaactgtgcagctaccaccacacaatcaaagcggaaaggccacttctctaggtgccccaagcaatacaagcattactgcatcaaagggagatgccgcttcgtggtggccgagcagacgccctcctgtgtctgtgatgaaggctacattggagcaaggtgtgagagagttgacttgttttacctaagaggagacagaggacagattctggtgatttgtttgatagcagttatggtagtttttattattttggtcatcggtgtctgcacatgctgtcaccctcttcggaaacgtcgtaaaagaaagaagaaagaagaagaaatggaaactctgggtaaagatataactcctatcaatgaagatattgaagagacaaatattgcttaaaaggctatgaagttacctccaggttggtggcaagctgcaaagtgccttgctcatttgaaaatggacagaatgtgtctcaggaaaacagctagtagacatgaattttaaataatgtatttactttttatttgcaactttagtttgtgttattattttttaataagaacattaattatatgtatattgtctagtaattgggaaaaaagcaactggttaggtagcaacaacagaagggaaatttcaataacctttcacttaagtattgtcaccaggattactagtcaaacaaaaaagaaaagtagaaaggaggttaggtcttaggaattgaattaataataaagctaccatttatcaagcatttaccatgtgctaataagtttgaaatatattatttcctttattcctttcagcaatccatgagatagctattataatcctcatttcctacatatggaaacagggccaaagaagtcaagtcaaataatctaatccagatttagagagttggagattggtagagacagactagaaatcaagatttatctaaatcaaaatctatgctcttaaccatcatttttgttagtctgaatcggtgcaacctaactcaataatataacccaaggttttatactgaactgtgttttggtatgattgtgagatgtcaagaccgtcttcccacaggcacacagaatgagaaatcctggcctatattgctgttaccatcatgctttctatagaattggcttttattatgtttctttgctcctttataaattctcaatgatgtgactacatttttacattattaaagcaaatagattggccccataactagggaaatgaatagagatggaaaagtaaatgcttggcattccttaagccctgggtaagtgtttatgctcaataaaatataaataatattactgaaagaggctgtttatatgggagtaatggtcagtgacaacactggagagaccaggtagggaccggttgtgaccatatcctcatttatgttcttgatgacagcatatatgattgctctcaggtaaattttgatgcagtaaattcatgaccataacatctattacttgggaccatcttgccaagtgctcctttactccatgaaatatttaataaacactgctttaaacctggaaaagcacaatctacatttagtgaatatttcatagaatatttaactttttacattgattacgtggttcacttacaaaaatcgatggaagatgccccccaacttgtgcctgtcggccaagcagcttcttttttagaatctttgcaaattttactttgcaatgtagattccatagtgaagtggagaattcagacaaatgctgaaatcgcatattaccttctagcatccatggtgttttgagtgaagctggggctgtacttacatatgatacataaatagctcccctattagtaaaagctaagccaaacaactgataattttcaaaatctattttttctcctgatttaatggtcatacttgaaacacaattatatccaactgatccatgttgtatatgccttattttcaaaagtctcatttaagctcattcatgccctttctcttatgtagtcttcttcgatacgaaaggagcttggaataaatatccattagagcttttaaaaacacaaaacaatgctttaatgtttcttttttcctggactgagtttggctgaccaacaaaatctctcaagccattttgttttgatcctaaaatatcaatggtggctctcgaaatttggtagatctgatatcaagaaagaatttcaaagatttttatatcttttcaaaatgtattttatagttgctttgcatacactaaataactttgtttatgtaaactgtcaatattatcatgtaataaaataaatttatttttaaaacaaa

SEQ ID NO: 111498 - DNA, 624 bp, Homo sapiens
  Payload ID: 1832
  Gene Symbol: BTC
  Gene Name: betacellulin
  ENST ID: ENST00000512743
  CDS Start-End: 1-326
gtctagtgatccttcactgtgtggtggcagatgggaattccaccagaagtcctgaaactaatggcctcctctgtggagaccctgaggaaaactgtgcagctaccaccacacaatcaaagcggaaaggccacttctctaggtgccccaagcaatacaagcattactgcatcaaagggagatgccgcttcgtggtggccgagcagacgccctcctgtgtccctcttcggaaacgtcgtaaaagaaagaagaaagaagaagaaatggaaactctgggtaaagatataactcctatcaatgaagatattgaagagacaaatattgcttaaaaggctatgaagttacctccaggttggtggcaagctgcaaagtgccttgctcatttgaaaatggacagaatgtgtctcaggaaaacagctagtagacatgaattttaaataatgtatttactttttatttgcaactttagtttgtgttattattttttaataagaacattaattatatgtatattgtctagtaattgggaaaaaagcaactggttaggtagcaacaacagaagggaaatttcaataacctttcacttaagtattgtcaccaggattactagtcaaacaaaaaagaaaa

SEQ ID NO: 111499 - DNA, 10729 bp, Homo sapiens
  Payload ID: 1833
  Gene Symbol: CRYBG3
  Gene Name: beta-gamma crystallin domain containing 3
  Uniprot ID: Q68DQ2
  ENST ID: ENST00000389622
  CDS Start-End: 168-9080
gtcgcgtccgcacttctcctgcccgagagagactgagccgcgctggcagctcgcgtcgagtcggtctgccctagccgcatcccgcggcgcccggtcgggctccgggcaccaggcaacacctaggccgttcccttcagacagccccgggccagcggccccctcgggaaatgtccagcggccgcagaaggggcagcgccccctggcacagcttctcccggttcttcgctccccgaagtccttcccgggacaaggaagaggaagaggaggagaggccggggacgagcccgcctccagctccaggccggtccgctgccagtgttgaaaatgagcccatgagcacaagtcagaaaaaggaaaatgtactttcatcagaagcagtaaagattcgccaaagtgaggacaaaaggaaccatgctgagaagccagtcactcttccagtgcaggaagatcccaaaaaggcatatgatctttccagttccacttcagataccaaaataggagaaagtgacagacagccaaaagaaagcttttttcagtttcttggtaacttattcaatatctcggggaaatcatctctaggtgaagctaagcagtcttctttcaaagatgaccaggataaaactgagaaggatttacaaaatcccagtgaccatcatgaagacgggatcaaaagggagagagagattttcagtggctccctaagaacccagacacatccaacagaagaacaagactctaactcatccgaactctcagatgctttttctttggatacaacacaagacagtgaccaagaaaccactaatttgctaaaacaaatcgatggtaaaccagagaagccttcagtaacatatgcaacatatcgaggcccaagacacattgggaaatatttaaagcaacagacaggcttggcaactgtgaataccttggacagagaaaatgaaagttctgactctagtacaaacagacacattgaccctggaagtgagattgaggctggggtactgccactgttgttatcagctagtacagactcatctatgaaaggaaatctacttgaaggcccattagaagactctgattgtagcaaaacaagtttcaacaaggaaaattctttgacaaataacccagaactgcagaatattgcctcttccaataatcttttaaataaaaatgcttgggggagtattgagagaaataggtcatccccttcttctgtgactaactccagctacgatggagaatctgactcacagcaccatttaagttgtgaaccggtttctcagactaacagaaatttggtatgttcagcattgttaacaggaagtaaccatcgcaaagtcccttgcagcccagattttcagagagtaactacaacagaaaatacgataaaagaaaacagcactgtgatgagtaataggacattggtgcaaagagaggagcttgttgagcctcagggccctgctatttctgatttctcttgtagtaaatctgatgggagtgacactactgagcaggaaagtacaaatttgccaagtccaaataaatcaattaggcatgaacatctgcagttgccagagagtgagtgttctgacaagcaaaccatagatagctcatcaaagcaagctgccactcacaccaatatcattgctcttcagagacatgctgtgacagacacagaatttgtaaatgaaggaaagagattgtctgcccaagactcacagaaaaatgtggctgttagagaaatcaggcgagaaacagaaagtgcctcagctggtgaatccatagcttcaagtcatgtaaaagctccagaagataaaattgagtcattacccaaagatactgaccaatactttgaaaccaaagccaaaaagcttgattttaggtcacatgataaaattcctcatattagaatgaataaaaaagacctggcctctttaaattacatcagtgaatcagcagttgtagcaagcttaggaaatgaaaatgcacctgagttgaaatttgaacttaatagaagtcacatttcagaaactcctcttgactctgagagtcctcaacaagctgaagtatcacctgatgctaaaacatctcttagccttgactgtaaaaaactaaatttcagtatttcacctcctacctttgtttctggagttgggatgctgagcaagttggatattcctgatttaatgaatgagggttctcctgtgcccattgaaactgggaatgtcaacattgttggtatttcctatcagcctaggaagtgtaaagaagaaaatgtgaaaaaccatgttgaggctgcaggcaggaagagtcctcctccttccttttgccttgaatatacatctgcaatttttgaattcaaagaagttctttctaatagtgaaaaatgccaggttcttccaggttctgaagccagtggccctcacttaactgggttggagctattgagctttgactctggaaacctctctaaggattgcagttccattttatctcaagaccctaatagagtagagttagtgtcttcaaacactaaagcaaatatgagcataatagagaagtctgattctctttccttggaagccaaaactgctaacattgtatcaaaagctgaaattgatggtcagaacaatgttcttgtggagtcacattctggaagaggaaaaactatatccttgtccaaggtatctctttcaaaagtggagcccagaaacatttctcaggataaaatgtcttcttttccattgaaaattacccatgttccagaaaagcctattttgtcagaattaacctttctagaagttgaacagggcaaacgttttcaatcaattaatcataatgagataggagagaaatgttcagatgctggccttaaagagaattgccaagctgagctttctcctgctgcctccaaatatgaagataagccagaaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatctcacacatgaaggtacctctgtaactaacctgttgtaccctactacctcttatttggaatttgaaacgtctgtctcaattgggacagaagtaaccccatttcaggaacattttgggatttatactgggaagatatccattgatttcccaactgctgcccaatttgacaatctcgtggaagcagagactggagcagttgctgggcctgcagcgtcagttaacagctcaggccaacagtgttctgaagcctctgctgagcacatagaagccaggagaagagcacatgaccaacttttggacctcaaaagtagtttactcaaaaaggccgatacattgattggtgagatttttaattctgtcagggaagaactaaaattcaaacacacagtgagtacctgccaggagcatatagccatagaaggtataatgaatctgggtaccctgaaagaagacatctctgagaaaaacccatcagaagtgacactaacagaaatacaacagacagagggtttggaagagcaaggcatggaaaacatgtcagaagtcaaagagaagccctgtgtttcaccaacagttggtgagaagaatcttcttgttgatcctaatagtatgaatgtatcttgtttgttagaagataaagctagggaattagtcaatgagattatttatgtagcccaagaaaaattgagaaatgatacttttgaagatactgaggatacttgggattctgaacttcaggctaatacttcaaaaattctgaacagtgatagtgttaagccacatgatgtagttagagagttcttggtttcagaacagccagtaaatcaaagcacacaaattagtgaaaataaagtattaaatgaattcttctccctaagtaacttagctagtggcacagagtcaattaagggaggagaaattgttctctaccaaaaatccctattttctggaaatggatctggactgtctgatagtataaatttgcaggaatcagatacggttttactagctgaagacatgtcacataaacggttagatgatagggtaaaaacacatttatttcgcagtgaggactgtaatgagacaatggaaatagagaatgtggataataacaaaactgagacagaggacagaagaactcttgtattaaatttcaaatggcctccacttgtgaatgatgacatccatgcacctggtacatctaaaagcagtttgtctgatagccttgtatgtatatctgaaaaaaacttgccaggacacagtaaaaacacacctcttgcaatgtcagatgtagggaaagtacacaagaaggataatgaaataaatatagggaaaattgaacttataccttccatgttagaaacagggaaaacaaacaaaaaggatgctgaattgaatattctgaaatatgaggcagtccctcctatgatagaaatgggaagaatacataaaatggatgctgaattgaatgtcacgaaaactgagccaaaagctaatgtttttaaaatgggagaagtataccaaatggatgccgagagctgtattgaaaaaactgagggatcagctgtcattttaggaatggaaaaagcttataagatgaaggatactgaaggggatattggcaaaattgaggtgatacctatgatgccagaagtgaaaaatatccaccaaaaggatgctgaaggggatattgtaaagactgagatgacacctgttacagtagacatggaaaatatttaccaaacgcatgctgaaggggatattggcaagactgggacgatagccttgtcagaagtggaaaatatccaccaaaaaggtggtgaagggattagtgaaaaggctgaagtgatacccgttacattagcaatggaaaatacttaccaaaaggatgctgaaggggatattggaaaggctgaagtgatgcctgtgaggttagaaatggaaaatacttacccaaaggatactgaaagagacggtggcaaaactgaggtgatgccccttgcattagaggtagtaaatacttaccaaaaaaatgccaaaggttttaccgggaacactgaagggtctgtgttgaaaatggaagctacttaccgaaagactgctgaagaggtcattaagaatactgaaatagtaccgtgtgtgttaaaagtgaaggaagcacacgagacagcacctgcccccttagaaatggaaaaagcatgcaagagagatgttaaagagactattggagcaactgtgtccacaccctctgtgatagaaatggaaaaaatatccccagaagatcgtggtgagaatattgggaaacacaaagtgttacccgcagtggtagacattgagaaaatacatggaacaggactagaattgaccactaaacaaggggaggccatgcttcctgcatttgaaagtaaaacaccacaagagtatgctgaagggagtgttgaagaaacaaaggaagagcctacagaaataaaggaaggcttgatagcacatgaaaatagacttcctacatatttcaggggatatgaatcccctacattaagtaaggattatgagggctacccagccccagcaatgccagattttcaacctggggataccacagtaagactagacaaaagaatgtctcttactgcaatatatgacaagaggagagagacagattatagtgacaaaggatataatttagcttttgtttctcaagatgaacaagaaaattcttcctttactatattatacgaagagccccttcaagaggaggacaagtatgcttccgcagaagcaagacaaacacagtctgtcttgtttcatgatacgtccgctgacagcatgcctgttctggcatgtgaaaggtctgagagtagaactgaccttgtccatcactttgaaaaaggtactaaattaggtgagacatttgatagtgatagttcagaaatgttcttatcagtggaggccaaaaggtacaaaatttatcctttagcattgtctcccatttatgaggatgacagctcacaggaggacattctatctagtgaggtttcacctggtcaccatggccccaggaaatcaagagacagtgaaaaccagtcctcttctgttttatcccttctccagtcagtgtcagaacgtttaaagatgaattttgatgaagatgacagagaggcagctgatgaggaagaagaggaggaggaggcagcagtattgcataaaggagatctgagagctggaagtggggagcgtgttaccttccagttgccagatccttccatcacattttaccctgatgaccaggagagcgttggaatttctaagaattcatatgtgatgccaaatgaacctactacctccaatctgcaagttggtctgtggccagaaaagacctcgtttctccagaaatctgaccttacttctaaactacattcttctttaaagagtgcttatcatcagtatctgcagacttcccaaagtcattcctcagaaaaaggagccagatttggtggaatttttcaggaaccagtgtcaaaatatttccgtgttcaagacagcccaggcagattgagcccatttatagagaatgttgacaaacaaactctgagatgtaacccaagacctgggaagatggttatctatgatctccatgaaagtacatataaacaagaagtctactgtaatattcctgatgctacatcatggtcttttccaaatggagttctaataaaagttgtaaggggctgctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggactgcagcattccagaaatagagcttttcccacaatctgacccagcctgttgtcctgtctacatacagagagcagtccccaatttggaagaactgaatatctccaaatctgtgtccttcactgtgaagtcaggagtttggcttgcctacccagatattaattttaagggacaagctacagttctggaggaagaccatgggctctttgagatttctacagcagaaatgaaatcattacatccgcttcaaatgggtggactgaaagtggaaatgcccatgaacttaaaggttattatttatgaaaaacctcacttccatggacaggctaaagagtttagtgaacatatagattctgttcctaattttttgaaaaataatggagattttcacagaattggatcaattcgtgtcattggtggagtgtgggttgcctatgaaaaagaacattttaaaggccagcagtttctgcttgaagaaggagactttgaagacagtaatgcttgtggtgcattaagtagccctatcttgtctttccggtacttacaagctaattttatagaatcttctgtcacactatttgaatctgacctagaaagtgggaagtttattgacattacaaatcaggaaatttctgatttggaagaaattggctttggcagtaaaacaagatccattcatgttaaaagtggagtatgggttgcctaccagcaaaagttcttctgtggagaacaatacattttagaaaaagggaaatacaaatgcttttttgactggggaggatcaaataatataatcatgtcgatacggccaatccaactggaaccacttgggataaatgaacctccgcatttgctcaaagcattcagcaaaccagggttccaaggtgaatgtatagattttacagaagaaacttctgatttgacttcactcatgccatgttcttttaaagttcttcgaggttgctggctcctctattaccaagaagacatgtttgttaatcactgtgtgttagaagaaggcctctatgctgaccttacttcctgcggttgcccagcatctaaagtcaaatctctcaagcccattgactatgtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaagaatactcagatctggtactactgccgaggactctttaaatccaaggccagtgatacatgtcttgatgtgattggtggccgggacacacctggagctaaagtagctctatggactgaacatgggcaattcaggcagaagtggagactgaataaaaatggaactatcagctcttatctcagtgatcaacttgtccttgatgttaaaggaggaaattattgtgacaagactcatgtaattgtaaatcagcccctggagggagaagaaacacagaaatgggacattgaaatattgtgagagaatcaacatccctagaaagatccctagaaagagcaaagaaggaaacacatctgtcattgtcttgtggacgtggaaaggaagctactgtcctcacactcctggatcactgagcagaatgaacattttctccagcctctgagactatcgctcttaaccatggaaaagctcaaaatattcttgccattactcagtgttcctataaagaaaatattatgatatcttggaaaggttctattcctgatctccagctgtggtgagcaagtttcctgaagtgtttattttctctcatatccaccaaacgtgaatcctgttcctgatggcccgttattggacactggtgatgctattatcctgtattatttattaatatcctacctagatgcttgtatgagtacaaagcataaagaaacagatttctataggtcaagtcatacttttgcaaacagatgagtaattttttagcaacacctgaaaatatactaaactttcctagataaactttaaggtttctatactgaggcttttataatgaacgcacctcgttaagtatttatacttgtaactaaccccaggcagggacctcagctttgttaggaataaggcacaagaagtattttctgtagctattgtttcctcagtccttcaaactaaaaaagtacaaataaataacctatggccaaacttgcactgttacgtgttaaccaagacatccctttaggtgacaagactctataacagtggttacctgtctccatgttgacacttcatcctagatttaaggagaggcatcaatttttttttttttttgcctcaagagaaatttcaaatatccaaattaaaacacagtagcatttgaaccttgaccttaccatctctttaagtaaacgtggagttgatttctctactaaataacagaaacctcagtttttcactcccattgtaagtaacttttatttaagtaagtaaaatcaggtaggaaatcacctttgacttagcttccagtagtcattaccaccttttactgcacaattcacaagcatgttttcctggtgaattggactgaaaattacattttgacaactttttttccttttatccccaacttttgccagaaagcagaaaaatgctctatttttataaagaaagattaaattctccaatgatattttaaaaaatatcaacctacatgcactttagaatgtaaaataacaatgactattttaaactcgaagacccactattttgagtattttttatagactttaaatactgggtttttttcctccttcaatctcaggcttttctccatcttttaagcagcctctgtaactcccttttgtccataggtgttgcgtgcctctcatctgtggggaagtattatttaataaaatttatgttacaggataactttattttaatgggcatgggcttgtctatacacaaaggtatgtatattttcattataaaaaaccagtttaaaattttttcttattttaattgtttgaaatttttctagagccaaagaagctctttaaagaagttgtttcttccaaagaacaaagccaggttaatgacattcaattctaaatgatacattggaattgtgccttttctaccacactggattaaataaacttgtcaaaata

SEQ ID NO: 111500 - DNA, 578 bp, Homo sapiens
  Payload ID: 1833
  Gene Symbol: CRYBG3
  Gene Name: beta-gamma crystallin domain containing 3
  ENST ID: ENST00000495403
  CDS Start-End: 186-578
aattgacccattccatggaaaaagatagttagaatcctactttactccaaacacaaaaataagttccagatggattaataacaagctaaatgtgaaaagcaaactttacaacttagaagaaaatataggaatctaccctgatgatactgcagtaggatggatttcttcaaacagaaaaagcacaaatgaataagaaaaaggtttttgaagaaccctccatcagcctttttgctctggagcattgtgagggaagagagttacatctagaagaggctgtgaactctgttctgaacaaggacctacacttctacacccagtctgtgtgggtaaaaagtggactatggatagcttatgaaggatccaatttcttgggaagacaaatcctactcaggcctaatgagatcccaaactggacagcattcagcagatggaaaacaattggttccctccgtcctatgaagcagcctgcagtgtacatcagaataaagaaccgtgcccagggtgaatatctgacagtcactggaagtctagcagacaccagggcaacatctgtgtgcatttctccctatagtggaaag

SEQ ID NO: 111501 - DNA, 2502 bp, Homo sapiens
  Payload ID: 1834
  Gene Symbol: BHMT
  Gene Name: betaine--homocysteine S-methyltransferase
  Uniprot ID: Q93088
  ENST ID: ENST00000274353
  CDS Start-End: 108-1328
gtataaagaggcaggctgcggactcggagcagctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgctgcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataagaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagactata

SEQ ID NO: 111502 - DNA, 1207 bp, Homo sapiens
  Payload ID: 1834
  Gene Symbol: BHMT
  Gene Name: betaine--homocysteine S-methyltransferase
  ENST ID: ENST00000524080
  CDS Start-End: 78-839
agctcggggctgcgcagcgggaaggctcgcctagtcggtccgcatccgtgtcgaccacctgtctggacaccacgaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcaggagcatccatcattggtgtgaactgccactttgaccccaccattagtttaaaaacagtgaagctcatgaaggagggcttggaggctgcccgactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgctgcacaggaaaagtaattcagatgttaatgccacttgaagaagttggtaggctagcaaagaggatgagacatgaactgtcataaaggactcagcaaccag

SEQ ID NO: 111503 - DNA, 2050 bp, Homo sapiens
  Payload ID: 1835
  Gene Symbol: BHMT2
  Gene Name: betaine--homocysteine S-methyltransferase 2
  Uniprot ID: Q9H2M3
  ENST ID: ENST00000255192
  CDS Start-End: 67-1158
gggctgggggcgggctcctagacggccgcgcgcccgggaacccggcgcccacagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgcaatcccagcactttgggaggccgaggcgggcggatcacctgaggtcagcagttcaagaccagcctgaccaacatggtgaaaccctgtctctaccaaaatacaaaaattagccgggcatgatggcgggtgcctgtaatcccagctactcgggaggctgaggcaggagaatcgcttgaacccaggaggcggagcttgcagtgagccgagatcaggccattgcacttcagcctgggtgacagagtgagactccatctcaaaaaaaaaaaaaaaa

SEQ ID NO: 111504 - DNA, 524 bp, Homo sapiens
  Payload ID: 1835
  Gene Symbol: BHMT2
  Gene Name: betaine--homocysteine S-methyltransferase 2
  ENST ID: ENST00000518666
  CDS Start-End: 320-524
acagagccgcggcaccatggcacctgctggacgcccgggggccaagaagtgtctttggggcctctactgttacaacaccaagattatcacacactaatccatgtgaatgtgtacctgggagttaaggtgttaatgggaaggaactaatctcacctctctcctcagctagcaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaatta

SEQ ID NO: 111505 - DNA, 578 bp, Homo sapiens
  Payload ID: 1835
  Gene Symbol: BHMT2
  Gene Name: betaine--homocysteine S-methyltransferase 2
  ENST ID: ENST00000519743
  CDS Start-End: 15-191
agagccgcggcaccatggcacctgctggacgcccgggggccaagaaggggattttggagcgcctggagagtggggaggttgtgattggagatggcagtgatagaacacccagacgcagttcgtcaacttcacatggaattcttgagagcaggatcaaatgtcatgcagacttttaccttttctgccagtgaggacaatatggaaagcaagtgggaagatgtaaatgctgctgcctgtgacctcgccagggaagtggctggcaaaggtgatgctttggtagcaggggggatctgccagacatcaatatacaaataccagaaggatgaagctagaattaaaaaactttttcgacaacagctagaagtttttgcctggaaaaatgtggacttcttgattgcagagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccg

SEQ ID NO: 111506 - DNA, 1537 bp, Homo sapiens
  Payload ID: 1835
  Gene Symbol: BHMT2
  Gene Name: betaine--homocysteine S-methyltransferase 2
  Uniprot ID: Q9H2M3
  ENST ID: ENST00000521567
  CDS Start-End: 17-916
acagagccgcggcaccatggcacctgctggacgcccgggggccaagaaggggattttggagcgcctggagagtggggaggttgtgattggagatggcagctttctcattactctggagaagagaggctatgtgaaggctgggctctggactccagaggcagtgatagaacacccagacgcagttcgtcaacttcacatggaattcttgagagcaggatcaaatgtcatgcagacttttaccttttctgccagtgaggacaatatggaaagcaagtattttgagcacgttgaagaagctgtgtgggctgtggaagtcttaaaagaatcagatagacccgtggcagttaccatgtgcataggcccagagggagacatgcatgatataacccccggagaatgtgctgtgaggctggtgaaggcaggggcttccatcgttggcgtgaactgccgctttgggcccgacaccagcttgaagacgatggagctcatgaaggagggtcttgagtgggcagggctgaaagcgcacctcatggtgcagcctctggggttccacgcgcctgactgtggcaaagaggggtttgtggatctcccagaatatccctttggactggagtccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacacggcagctggggaagtggtttggacatgcacaccaaaccctggattagagcaagggctcgaagggagtattgggagaatctgctgccagcttcaggcagacctttctgtccttcgctgtcaaagccagacttctaaggagtagtgaaagaaaaccctgaaataatcgaacaggaaaaagttgccctcaagcctgacctggaaccgttcctcaccttcatcctcaccatgccctgctatctccagctgctgagcagctgaggtgctgcagccccttcccttccagcccacaagtgtgtgcatattgagctcctgctgtggttaagcactgcaacagactctaccagagatgcaaagagaagcgagagaggcaccttgttctccaagaacttactgtccaatcatgctgtggtgcattcctttgaagatcatgaagaatagccaaacttgtctttgagggtgaatttgacactttaaaataatcagaagtcactgagacccaaagctagtgaataattcaagtgactaagctagatacttgaggatgatagagcaacactaaactaaagcaatgagtctgctttttttaatgatttatacaatgactccaaaggcaatcccaaagaaaagatgtaaagaatgttttgagcaatggtagcattattgaaataaatgtttaactatccaaagtgattactttcaaagatgatttttacttaaagatattaggtctggccaggcgaagtgactcacacctgc

SEQ ID NO: 111507 - DNA, 6326 bp, Homo sapiens
  Payload ID: 1836
  Gene Symbol: BACE1
  Gene Name: beta-site APP-cleaving enzyme 1
  Uniprot ID: P56817
  ENST ID: ENST00000313005
  CDS Start-End: 462-1967
acaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagtcaataaacctgggcaagtgaggcaagagaaatgaggaagaatccatctgtgaggtgataggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtacatggaggaattgggacctggttatgttgttattctcggactgtgaattttggtgatgtaaaacagaatattctgtaaacctaatgtctgtataaataatgagcgttaacacagtaaaatattcaataagaagtcaaactactagggttacttttttttcctcaatcagagtctcattttatccatttggagtagagtggctaaaacaatactgaggcttctggaggctttcggtaagcaaggcatctggttggacagtgggtgagcaccaggctttaaatctgcatacatgagccttaaggaaatggactagaggctgagccaaaccaaagcagaatggccttagagcaacagcaggttcctaggtggtttttatattgtatttgaaaacagccctgggcagggatatcataatttcaaggccaaactaaacatcatcttccctacaatctgcatcccccaaaggaattgcaagatgagggggaacagactgtttctgcataatatacatagtttcatttacgaacattggaatacagactttctatacacacattacctatataataaaaatgtacatggcatgagtatatgtcactgtataaatatagagttttagaaatcttgaa

SEQ ID NO: 111508 - DNA, 1333 bp, Homo sapiens
  Payload ID: 1836
  Gene Symbol: BACE1
  Gene Name: beta-site APP-cleaving enzyme 1
  Uniprot ID: P56817
  ENST ID: ENST00000428381
  CDS Start-End: 4-1302
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctgctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattccc

SEQ ID NO: 111509 - DNA, 1408 bp, Homo sapiens
  Payload ID: 1836
  Gene Symbol: BACE1
  Gene Name: beta-site APP-cleaving enzyme 1
  Uniprot ID: P56817
  ENST ID: ENST00000445823
  CDS Start-End: 4-1377
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctgcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattccc

SEQ ID NO: 111510 - DNA, 1236 bp, Homo sapiens
  Payload ID: 1836
  Gene Symbol: BACE1
  Gene Name: beta-site APP-cleaving enzyme 1
  Uniprot ID: P56817
  ENST ID: ENST00000510630
  CDS Start-End: 27-1157
aatagataggagagcaagcctcaccaatggttcccttcatctatctgcaagcccactttacactctgttctgggtggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacag

SEQ ID NO: 111511 - DNA, 1465 bp, Homo sapiens
  Payload ID: 1836
  Gene Symbol: BACE1
  Gene Name: beta-site APP-cleaving enzyme 1
  Uniprot ID: P56817
  ENST ID: ENST00000513780
  CDS Start-End: 4-1434
accatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattccc

SEQ ID NO: 111512 - DNA, 4083 bp, Homo sapiens
  Payload ID: 1836
  Gene Symbol: BACE1
  Gene Name: beta-site APP-cleaving enzyme 1
  ENST ID: ENST00000528053
  CDS Start-End: 465-1868
gccacaagtctttccgcctccccagcccgcccgggagctgcgagccgcgagctggattatggtggcctgagcagccaacgcagccgcaggagcccggagcccttgcccctgcccgcgccgccgcccgccggggggaccagggaagccgccaccggcccgccatgcccgcccctcccagccccgccgggagcccgcgcccgctgcccaggctggccgccgccgtgccgatgtagcgggctccggatcccagcctctcccctgctcccgtgctctgcggatctcccctgaccgctctccacagcccggacccgggggctggcccagggccctgcaggccctggcgtcctgatgcccccaagctccctctcctgagaagccaccagcaccacccagacttgggggcaggcgccagggacggacgtgggccagtgcgagcccagagggcccgaaggccggggcccaccatggcccaagccctgccctggctcctgctgtggatgggcgcgggagtgctgcctgcccacggcacccagcacggcatccggctgcccctgcgcagcggcctggggggcgcccccctggggctgcggctgccccgggagaccgacgaagagcccgaggagcccggccggaggggcagctttgtggagatggtggacaacctgaggggcaagtcggggcagggctactacgtggagatgaccgtgggcagccccccgcagacgctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccact

SEQ ID NO: 111513 - DNA, 611 bp, Homo sapiens
  Payload ID: 1836
  Gene Symbol: BACE1
  Gene Name: beta-site APP-cleaving enzyme 1
  ENST ID: ENST00000504995
  CDS Start-End: 491-611
ctggagctggtggctgcccagagaccggggagagagaccacgggtagagctcaacatcctggtggatacaggcagcagtaactttgcagtgggtgctgccccccaccccttcctgcatcgctactaccagaggcagctgtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctga

SEQ ID NO: 111514 - DNA, 561 bp, Homo sapiens
  Payload ID: 1836
  Gene Symbol: BACE1
  Gene Name: beta-site APP-cleaving enzyme 1
  ENST ID: ENST00000510915
  CDS Start-End: 409-561
atgttttgctgagcagcctgaaagcagactctaggattcccctgagatgagataaggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaag

SEQ ID NO: 111515 - DNA, 5155 bp, Homo sapiens
  Payload ID: 1836
  Gene Symbol: BACE1
  Gene Name: beta-site APP-cleaving enzyme 1
  Uniprot ID: P56817
  ENST ID: ENST00000392937
  CDS Start-End: 90-1295
acaatgcacaaagcccaggcttgttcttcacagggcctgagctcaagatctaggaatatgagcaatagataggagagcaagcctcaccaatggttcccttcatctatctgcaagcccactttacactctgttctgggtggtccagcacataccgggacctccggaagggtgtgtatgtgccctacacccagggcaagtgggaaggggagctgggcaccgacctggtaagcatcccccatggccccaacgtcactgtgcgtgccaacattgctgccatcactgaatcagacaagttcttcatcaacggctccaactgggaaggcatcctggggctggcctatgctgagattgccaggcctgacgactccctggagcctttctttgactctctggtaaagcagacccacgttcccaacctcttctccctgcagctttgtggtgctggcttccccctcaaccagtctgaagtgctggcctctgtcggagggagcatgatcattggaggtatcgaccactcgctgtacacaggcagtctctggtatacacccatccggcgggagtggtattatgaggtgatcattgtgcgggtggagatcaatggacaggatctgaaaatggactgcaaggagtacaactatgacaagagcattgtggacagtggcaccaccaaccttcgtttgcccaagaaagtgtttgaagctgcagtcaaatccatcaaggcagcctcctccacggagaagttccctgatggtttctggctaggagagcagctggtgtgctggcaagcaggcaccaccccttggaacattttcccagtcatctcactctacctaatgggtgaggttaccaaccagtccttccgcatcaccatccttccgcagcaatacctgcggccagtggaagatgtggccacgtcccaagacgactgttacaagtttgccatctcacagtcatccacgggcactgttatgggagctgttatcatggagggcttctacgttgtctttgatcgggcccgaaaacgaattggctttgctgtcagcgcttgccatgtgcacgatgagttcaggacggcagcggtggaaggcccttttgtcaccttggacatggaagactgtggctacaacattccacagacagatgagtcaaccctcatgaccatagcctatgtcatggctgccatctgcgccctcttcatgctgccactctgcctcatggtgtgtcagtggcgctgcctccgctgcctgcgccagcagcatgatgactttgctgatgacatctccctgctgaagtgaggaggcccatgggcagaagatagagattcccctggaccacacctccgtggttcactttggtcacaagtaggagacacagatggcacctgtggccagagcacctcaggaccctccccacccaccaaatgcctctgccttgatggagaaggaaaaggctggcaaggtgggttccagggactgtacctgtaggaaacagaaaagagaagaaagaagcactctgctggcgggaatactcttggtcacctcaaatttaagtcgggaaattctgctgcttgaaacttcagccctgaacctttgtccaccattcctttaaattctccaacccaaagtattcttcttttcttagtttcagaagtactggcatcacacgcaggttaccttggcgtgtgtccctgtggtaccctggcagagaagagaccaagcttgtttccctgctggccaaagtcagtaggagaggatgcacagtttgctatttgctttagagacagggactgtataaacaagcctaacattggtgcaaagattgcctcttgaattaaaaaaaaaaactagattgactatttatacaaatgggggcggctggaaagaggagaaggagagggagtacaaagacagggaatagtgggatcaaagctaggaaaggcagaaacacaaccactcaccagtcctagttttagacctcatctccaagatagcatcccatctcagaagatgggtgttgttttcaatgttttcttttctgtggttgcagcctgaccaaaagtgagatgggaagggcttatctagccaaagagctcttttttagctctcttaaatgaagtgcccactaagaagttccacttaacacatgaatttctgccatattaatttcattgtctctatctgaaccaccctttattctacatatgataggcagcactgaaatatcctaaccccctaagctccaggtgccctgtgggagagcaactggactatagcagggctgggctctgtcttcctggtcataggctcactctttcccccaaatcttcctctggagctttgcagccaaggtgctaaaaggaataggtaggagacctcttctatctaatccttaaaagcataatgttgaacattcattcaacagctgatgccctataacccctgcctggatttcttcctattaggctataagaagtagcaagatctttacataattcagagtggtttcattgccttcctaccctctctaatggcccctccatttatttgactaaagcatcacacagtggcactagcattataccaagagtatgagaaatacagtgctttatggctctaacattactgccttcagtatcaaggctgcctggagaaaggatggcagcctcagggcttccttatgtcctccaccacaagagctccttgatgaaggtcatctttttcccctatcctgttcttcccctccccgctcctaatggtacgtgggtacccaggctggttcttgggctaggtagtggggaccaagttcattacctccctatcagttctagcatagtaaactacggtaccagtgttagtgggaagagctgggttttcctagtatacccactgcatcctactcctacctggtcaacccgctgcttccaggtatgggacctgctaagtgtggaattacctgataagggagagggaaatacaaggagggcctctggtgttcctggcctcagccagctgcccacaagccataaaccaataaaacaagaatactgagtcagttttttatctgggttctcttcattcccactgcacttggtgctgctttggctgactgggaacaccccataactacagagtctgacaggaagactggagactgtccacttctagctcggaacttactgtgtaaataaactttcagaactgctaccatgaagtgaaaatgccacattttgctttataatttctacccatgttgggaaaaactggctttttcccagccctttccagggcataaaactcaaccccttcgatagcaagtcccatcagcctattatttttttaaagaaaacttgcacttgtttttctttttacagttacttccttcctgccccaaaattataaactctaagtgtaaaaaaaagtcttaacaacagcttcttgcttgtaaaaatatgtattatacatctgtatttttaaattctgctcctgaaaaatgactgtcccattctccactcactgcatttggggcctttcccattggtctgcatgtcttttatcattgcaggccagtggacagagggagaagggagaacaggggtcgccaacacttgtgttgctttctgactgatcctgaacaagaaagagtaacactgaggcgctcgctcccatgcacaactctccaaaacacttatcctcctgcaagagtgggctttccagggtctttactgggaagcagttaagccccctcctcaccccttccttttttctttctttactcctttggcttcaaaggattttggaaaagaaacaatatgctttacactcattttcaatttctaaatttgcaggggatactgaaaaatacggcaggtggcctaaggctgctgtaaagttgaggggagaggaaatcttaagattacaagataaaaaacgaatcccctaaacaaaaagaacaatagaactggtcttccattttgccacctttcctgttcatgacagctactaacctggagacagtaacatttcattaaccaaagaaagtgggtcacctgacctctgaagagctgagtactcaggccactccaatcaccctacaagatgccaaggaggtcccaggaagtccagctccttaaactgacgctagtcaataaacctgggcaagtgaggcaagagaaatgaggaagaatccatctgtgaggtgataggcaaggatgaaagacaaagaaggaaaagagtatcaaaggcagaaaggagatcatttagttgggtctgaaaggaaaagtctttgctatccgacatgtactgctagtacctgtaagcattttaggtcccagaatggaaaaaaaaatcagctattggtaatataataatgtcctttccctggagtcagtttttttaaaaagttaactcttagtttttacttgtttaattctaaaagagaagggagctgaggccattccctgtaggagtaaagataaaaggataggaaaagattcaaagctctaatagagtcacagctttcccaggtataaaacctaaaattaagaagtacaataagcagaggtggaaaatgatctagttcctgatagctacccacagagcaagtgatttataaatttgaaatccaaactactttcttaatatcactttggtctccatttttcccaggacaggaaatatgtccccccctaactttcttgcttcaaaaattaaaatccagcatcccaagatcattctacaagtaattttgcacagacatctcctcaccccagtgcctgtctggagctcacccaaggtcaccaaacaacttggttgtgaaccaactgccttaaccttctgggggagggggattagctagactaggagaccagaagtgaatgggaaagggtgaggacttcacaatgttggcctgtcagagcttgattagaagccaagacagtggcagcaaaggaagacttggcccaggaaaaacctgtgggttgtgctaatttctgtccagaaaatagggtggacagaagcttgtggggtacatggaggaattgggacctggttatgttgttattctcggactgtgaattttggtgatgtaaaacagaatattctgtaaacctaatgtctgtataaataatgagcgttaacacagtaaaatattcaataag

SEQ ID NO: 111516 - DNA, 8764 bp, Homo sapiens
  Payload ID: 1837
  Gene Symbol: BACE2
  Gene Name: beta-site APP-cleaving enzyme 2
  Uniprot ID: Q9Y5Z0
  ENST ID: ENST00000347667
  CDS Start-End: 464-1870
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattctatttcactagcttagttgtctctttttccaaatcttctctggaagtaggttggctattaccctgttgggaaacagggaaatggcctgatgcccctatttctgaccagctgtcagggaaggaagatgcaagatgtgcagaagacacaaggtaacgtctacttatccccgtgcttcgaaaccgtgtgtttccctttgcagaactggttagcctcaagcatacccatccaatcagcttaaattgttcagcagttgacctctgtgcttcttcctttgggggtgtttaatctttggtaacagttgtgcagtggtagccttatttcggggggcagtccctactttctgtcacttatcgaggcctttgccaaagaaaagtggaagccgtttccttgacatagccttatatgacctgatgtcattaggagaagagttaaaagacagtatcccctctctcctgcttgtgtgccaagttcagtgttccctttgcatttttttggggtgggttggctatattacagaattccaccaaaagtgctaagtgtcccctcctgcagaagtatcgtttgtattcacagtaggctacgtgtggatgtttcagccatctgctctgctccctgggtccccgggtcaccaccatactgagaaatataggactctgccaaagagacgtggaggccacgtcggcttgtcatggtgtcctggaagactctccagcagccagaagaaccttctgtgctgttttcactagagaagatttgagttgcagcctcttggaaagaacatgacggcacggaacgggaggagggggctcttgtatcagggcccgttgtcacatccgctctcagcttgttgaaaactcataatctcagaatgcatttcacacggagagatgtctggaagtccaattctcatcccattggctttttccgtggttgctgttttgtgggccgctttgcacaggagtgaagccaacacccctagattgtgccttcacccttgctgtgaaaaattcaaagccctgaaataagaggagggaatcgcagacatgccctgattagttttcctgcttatttcttcatacaggcatcttctgttccgttgtattgtgttaggtttcagaggcggggagcttcctcctgcagcagatgaacaggcatagttcttaaaatacaggaaagtaacaagtgaggtttccaggtagagtaggtgaatgaagtttgccgtcatgctctgtatttcatatcagatttctttatcttttcatatcgcatgtcattggatgtgacattttgatgaaaatactgaaactacaaaagcataacttcgcaacaagaatgagatagacaattgaatgtgggacatttttctggcatgtcttgctgctgagaatcggacttccagtcaaaaccctgttagtgacacccacctcctccagttatgcaaattgatgcttagcttggcaagctttcaaggaggtttgcttggaacaggaaaggaattaacaaccctttgagggtgtcatttttaccttgtaatacactgtggaaaattctggaagacggtccttgcctgaaaaggtgcaacttagcattaggttgttatcagaaaccttgtcaagtctgatgggaaatgaatagatgctgctttatttccttgataacttctttggaagtctgaaataaatcctgccttcagtaactgaaaccatttattaaaaatagcaagaaacaagatggggaccaattctatttttattcttgggaatttgaaagagccacaagtgattggtgtccgatctcccagcatatactgtacactattttgtatttctcctgaaccaaaaccaagtacttagcactcaagaaacagatgccctgtgtgtgaccgaggggagtgtttttccacaacaggttccacttctgaacacttggaaggaccttgcctgattcatggtgaaacacagaggttttggttggagataaatttggggtcagttactgttcaaaattgtgaaagtagttcccaggaagacagcattagtgactccgcagtgctttgggtaatagattttgaaaagcaattgtgagttggggattccatcatttcatttaagaggtgaagagggatttaattatttaatacgccgggtgcaaacttgttaaattcctctttccctgtccctgcttggtggagctgccacgtgtggttcagttctaagttctggactagtgccactcgatatcattgggaataaatcgttgttcaacagtctgttccacaaacaacagtaattgaatttcacagactttatcctgattagtggaaatcaaataatggagtggaatccccatgtgttttctcttgcacaaacttattagacttgattagaaaactgtttggaggaaaaacttgccagtaagttttttggttgttgttttgttttttttgaaaaacgacgcaacaccataaagtgtaaaattaggggttctggccaagagaggtactagatttttttaatgccgagaaaagtccatgccacagaagttattgtgtatgtctctagggagctttaagaatttcacgtttgaactttacagctgtttaccaattaaatggcaagctggaaaaatacattttgagaggggtagaaagaataagaatataattaaaagtatgctaacaaaataagcagtacatatttttttagaaaatgcagtttaggccaggcacggtagctcgtgcctgtaatcccagcactttgggaggccgaggcaggtggatcacctgaggtcaggagtttgagaccagcctggacaacatggtgaaaccccgtctctactaaaaatacaaaaaattagccaacgatggtgatgcctgtctgtaatcccagctactctggaggctgaggcaggagaatcgcttgaaccggggaggcagaggttgtagtgagccaagattgcgccactgcactccagcctgggcaacagagcaagactccgtctcaaaaaaggaaagaaaatgcagtttcattccagccatccttagatttcttttccccttaaagtggctgaatccattggagatgtgatttattttgcagatccaccaattccaaacttcaggaatattcaagcgggagtcatgtgtaagtgacagctttgacaaagagagactgtggctgggtggcccgggtgttgcccacgcggagcaaggattggttcattcaacggatggagagtacaggatggctgggacctgggaagttccagaatctgaaaagagggcagggcaagaaggagccagaagagaggtcccacccctcagttggcagtggggcacggaggtccgcatcagccaagaacgtccccaggatgccgtgggcacctcatttcaccccacgtttttggcacagtctactttttaggtattttgtaaaggaacttctcaggattgattatttgccagaggaacaattaggccaagagaaacttgcttgacagccatgtgtaaaacacgtctgtcctaatcaaactagagatgcctcaaggcccacgcaggacacaggcaggttcaaggtcatgcacctggaaatttgtaggggagggtcaagcaactgaggccaaagggggccggtaaagtggcttctggggtctgagcatctggaaggctcctggcagcagttacctgacagtgtcgttgaggggcacggcagctgggccctcaccgtttccgccagctctgctgagccagcccagcccatgcattccgaacatccgacagcttctttctccagaatgtcttctgtcagagacttccaggaaaggagctccctcctgtctcactgctgtcagcgtgggagccctgctccccaggctccacgtccccggaaggtccatcttgtcctggagcacacccagccccattcagggtcagtgcaggagggaacagggaatctgcatttcagtaagctccccaggtgaggctgcagagcagaaaccacggctttcagacgtgagcaggctccctgggctcttggtgtcaccctgttagccacatctgcggaatgtggaaggcagaacatagccacgctgcttagtgctgccagcgaacctcaggttgcatcagtggctggaatctatcacagctgttggggatacgtaactcccagcaataaatccagtattttcttccctgccctgagcttcctctgggtttcttatcagcagctattacacacagatgtccagtgcttctaaactaaattgtactgtgtaacttttacatcacacttgtgtgcttaaaaagcacaccgtgggtagtgactgggccaagagacatcacaaagcttcctgataaatttgaatccagccacggcaagagcgacgtgcgggtacctggtccctgatgcttgggtgccccgttgagcctcgggtacttcttggacactattgtgagagcagccatcctggtgtctctgccagcatcttggggaacgctgtgatggtaaaatatctgtctctcctctgggaatcagggcagccctgagaagtgagcagttccctttacagatggataattgtttgtgtaagaccaaccagataaagtccaaactgtgtagaacacacgtgtgcctcacacatagccatctgagtaaaatattttttccaatgtagatttataattagaaatgacagatttataatatagacttcagtaagttgggcacagctgtcactttcgtggtatcaataaaaggctagaaaccttgggtgtccttggcaacctagcctttgacattgatgtttttccataggattttcttcatttgggttggaataaaaatgcatttttattcacaaggcacagacagataagaatatcataagcagggaagtgtctccaaaggtcaggacatatgtttttctgttgagtgctatatgtggaggtcattgcaagttccctgatatgagtatggtttcgcttgctacattgtgcctattaaagtaaaattttacacaagcctcgcatttctaagattagtgttcctgaatgaaatgttaagaaaacattaaaagattatctctttttaagatggaggaaaaaaagtgaacaaagctaattaatctatcatgaaaattgcacaaaataacatttcttaacaaatttaatacaattttgtgttctttgttgctagtggtataaaacgagatttttttccctcatttttctcattgtagatgtcatctctcacatttatatcagtgaggtttgaaattctgtgtagcagttactcagcacatatgagagggcagcgaatgaatgagatttgtcatgtgctaataaaagctgaatttttgtaatctaaaatgatgtattttctactattgctgttaatttgcattgttaaaaattcttaaagtttaatatgttatgttcagtcattgaaagcgaccactcatttttttcttaaagttgatgccttttctgctgtgctagagtcagtattttgcttctggcaggagagctgcaaactgtgtatcctcaaacagatgcaaaaagtagtgctttgcaaaacgtttgttttctgtttatctcagattaacatcctttaatacaagtttcttaagtgtaacttgtatttctgaaaatgcttaaaattattttatatttccctttgggaatttttctctatttccagcacgctgatttgatttaaaaatgtaataagaccaagagttggagtaaagggatattcattccatgttaaaagtggcttcatagctactgacaaatgtctgaactattgtcgtgcccttcaaaactggagttttctaaaataatcttatttttatacttgtatgttccagcaatttaagatatataccattgaaagggaaataaaacatttttgtttatttgaataaa

SEQ ID NO: 111517 - DNA, 2993 bp, Homo sapiens
  Payload ID: 1837
  Gene Symbol: BACE2
  Gene Name: beta-site APP-cleaving enzyme 2
  Uniprot ID: Q9Y5Z0
  ENST ID: ENST00000330333
  CDS Start-End: 464-2020
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 111518 - DNA, 2824 bp, Homo sapiens
  Payload ID: 1837
  Gene Symbol: BACE2
  Gene Name: beta-site APP-cleaving enzyme 2
  Uniprot ID: Q9Y5Z0
  ENST ID: ENST00000328735
  CDS Start-End: 464-1654
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggctctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaactattcta

SEQ ID NO: 111519 - DNA, 655 bp, Homo sapiens
  Payload ID: 1838
  Gene Symbol: BTRC
  Gene Name: beta-transducin repeat containing E3 ubiquitin protein ligase
  ENST ID: ENST00000370183
  CDS Start-End: 83-655
actgaaaagcggaggaagctctctggagaaacgccgtgaggccgctggcggggccttcctggtgtcagggttaccgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaa

SEQ ID NO: 111520 - DNA, 6134 bp, Homo sapiens
  Payload ID: 1838
  Gene Symbol: BTRC
  Gene Name: beta-transducin repeat containing E3 ubiquitin protein ligase
  Uniprot ID: Q9Y297
  ENST ID: ENST00000370187
  CDS Start-End: 119-1936
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaa

SEQ ID NO: 111521 - DNA, 6084 bp, Homo sapiens
  Payload ID: 1838
  Gene Symbol: BTRC
  Gene Name: beta-transducin repeat containing E3 ubiquitin protein ligase
  ENST ID: ENST00000393441
  CDS Start-End: 149-1888
gattctccttggcccctcagcctgcgcctgagaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttct

SEQ ID NO: 111522 - DNA, 5982 bp, Homo sapiens
  Payload ID: 1838
  Gene Symbol: BTRC
  Gene Name: beta-transducin repeat containing E3 ubiquitin protein ligase
  Uniprot ID: Q9Y297
  ENST ID: ENST00000408038
  CDS Start-End: 75-1784
ggcgctgcgttggctgcggcctggcaccaaaggggcggccccggcggagagcggacccagtggcctcggcgattatggacccggccgaggcggtgctgcaagagaaggcactcaagtttatgaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagcccagccccaatatgcttaggaggagacagagttccctctgtatagcctctgggacaagaaaaagaaaacacaagaatgtatacactggaagatttgggcctcctgcctgccttctctttgtttctgttcctcttcccatctactcccctacgccccttcaaccttttttctctgtctgcttcacctgagaagaaagtgtacgaagagagtgtcctcctctcacatgagccagatcagccagaaaatgcaacacttggaagagttaaatgctgttcagtgaagatttcagccccaggcctttgctgcaagtgaccctgtggcaacagtggattctcagacatgatactctcatcatatttgcaactcttctctctctttcttccccacacccaagaggaggattggtggtagggggcaggcagagggggtggggagaagtttcctgggctccatcaatggctgcatcttttctggactcagcagtctccttgattccatgtagagtgtggaaaggagttgctgattgcatttcctctcattaacaattgggtgtgtaataaaaagcattgtacttcatcttaaatcactggtaaggctcagcctacagaaagatttgaaatggccagagccaatcgcttggtgcattctgcgtaatggtttccatctccgatttcctcatcagggcctgtgaatacccaggtgcctgtatctttgccaagaccgtgatcaaggtagcttaagagagatggtcaggagaaaacactgtttttgttttttttgttgttttgttttgttttggccagttaaatatcatctctcaaatattgatctcaccgtgtcaaccttgcactgcacaaccttccttctgcttctcccacacccagtatttgcagaagggcaaagctgcttaagagagaggatcagggtgaagtttggcacacagggtttattaatggggcaaaaactgccttttcttcctcctcctgaccttattttgctcttcactctccccagccaataaagcgtctgtggcgattggtgaacagcataaacagctggacctcagcaagggtcaggcaaacccagtcactcggaaggcagctgtgtgagctgccaagctagtgggcttcaggtgcaagggtacctgtgccacaccaacctgggagcacacagaatactattaatgtgcacccagctggtctccccaggcaagaaggtatcctcttcccaaggtgtacccactgaatgttgttactacatattgagagtcattttatgcatatgcattctacctttcctgctttatgagtatttttaagcttttagttcaaggttatattcagaaaatatttcccagtataatgatacatcgtagcctaagaaatattttctcaatgtaattcccttcccagctacccaaatgctacagagaaatgttttctacttggccactatcagggttcgtcatctattgtgttgactattaatggctttttgattgggtaaggattttgctatagatgaaggtagagggctgtcagccctgaaaaacacacaggtcagacatttaaaaggcatgggtttcgagctgtctcaaaatattgcccaatagccataattttaccagcctttctgtcatatgctgctattacaaagtggaagctgttgaatgtttattggtgcccagggttttgctctccaatctaggttcagttgaaggaatattgtttctaagactgttttgagacatgtccagtacatcacaaaggagatcggggcgacccctgcagatgtggagccattagcccagttgaggatattctccaagttgtcctctctcctgctgatggaaatgggaatgaagttaagtggtctgaaaaacttgaatcgttcacatttctcagctctgggggtcatttaccagtttgttgtagaagaaataatcaggtaagttaaaagttcatttccagagaaggtaaaccccacttaccatctctgcatgatttcagtgggaattgattatcactaatccccaactgggctagaataaatgtaaagtttgacctttttaaaacgaaaagagagacaaagtctcagcacattccaaggagtggtagaaacagagctgaaggtgtccccattgtagattagtctcttctcactaaaatttactttccaacgtagggcctaaaggaaacctttcttaaagacaggctgaaaccccttcaaaggcagatgaggaggtacagacacgtgaccttttggtgcacactggagctacttggacaagaccagcatgccttgctgcacgtgtgtgtatttcactgctgagaacatcctttaacttggtgtgcaatttgaaaggatgtgaatcatggatggaaggccatttgtacatgtcccttggcaaaattctttctggtgtctcctaacttcagagacagggactctttttggatctctattgacaagtaataaaagtctggccctcataacttgtttccgaactagaaaagtctgtgagacccctacatcattctggtttttttgcttgagtaagaacaatccttttttatttttcttctgtacagtctaaagctacagagaaaaaaaaatgcactcttcccttgccggctcctggtaccattggtctgaacagctgtagttggtctactccttacttagcacttgattgtgtggggaaacaaaggtgggaggggtggggaatactggaaataatcagggcaatttttttctttcccataattggactagataccttggtactgttgaccttctcagcatctcccttttgccttagatggcaacaccctccagtctgtagcagagcagtccaacccagattagtgcagcccggaggcttagggtgcagcctccctggtcttcctccacacagttgttcaccaacagaccagacctcctttaaccacagtgtcaacatagtatcggaaagagagccatttcttaggggaataaaacagtttcgcttctttagctcatctgtggtgtcagaatccttggagctgaagagagaaatcaaaagagcatgatgatggctgcctggtttcaggtggaacttaatgcattgatctttagaagctccttctgttggaagttgagtacctgtgatctaaaatgtcctggaggcagatgacatctaaaatatgtgctttccaaccagcacagctggcgctcttagctcctgattggttgtgtgttttattaaggatcagtgcagttaagtcgtattttaaagtgttacctcccctcctaacccttccccttcttggacactgaaggaaaaggccaactagggtgttagccctctgggcaccaaggaaactaacagctttctcaaagcggtgaccactcaggccagcccagacaaatctgagggatggccagtgcactccaatgatgggacaggcctaacaacacatgtaagcttccccgagagctttcagctggttcacctctttgttctctagactcttaagtactgactgctttgacttttgtgattatgttatggtgatgtgtagtcagtgtaccaatatgttcacaacctaggatcatgataatggagtgtgttttgggttttttttaactgttcagaaaaaaagtaaattacaaatataagattaaagtgaattttctaa

SEQ ID NO: 111523 - DNA, 2495 bp, Homo sapiens
  Payload ID: 1839
  Gene Symbol: BID
  Gene Name: BH3 interacting domain death agonist
  Uniprot ID: P55957
  ENST ID: ENST00000317361
  CDS Start-End: 328-1053
gagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctgtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacactacga

SEQ ID NO: 111524 - DNA, 854 bp, Homo sapiens
  Payload ID: 1839
  Gene Symbol: BID
  Gene Name: BH3 interacting domain death agonist
  Uniprot ID: P55957
  ENST ID: ENST00000342111
  CDS Start-End: 91-504
ggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggggcgtcagacaataacacagcaagtgctgaggaagaaacggaggcggcagggagcgtggcagttgagcgtggccttcatggagctgcgacagtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccct

SEQ ID NO: 111525 - DNA, 1879 bp, Homo sapiens
  Payload ID: 1839
  Gene Symbol: BID
  Gene Name: BH3 interacting domain death agonist
  Uniprot ID: P55957
  ENST ID: ENST00000399765
  CDS Start-End: 175-474
ggaagcgcgcggggcgccataaggaggaagcgggtagtcgaccgtgtccgcgcgcctgggagacgctgcctcggcccggacgcgcccgcgcccccgcggctggagggtgattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtgga

SEQ ID NO: 111526 - DNA, 2129 bp, Homo sapiens
  Payload ID: 1839
  Gene Symbol: BID
  Gene Name: BH3 interacting domain death agonist
  Uniprot ID: P55957
  ENST ID: ENST00000399767
  CDS Start-End: 392-691
gaaggaggaagcgcgcggggcgccataaggaggaagcgggtagtcgaccgtgtccgcgcgcctgggagacgctgcctcggcccggacgcgcccgcgcccccgcggctggagggtggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 111527 - DNA, 2167 bp, Homo sapiens
  Payload ID: 1839
  Gene Symbol: BID
  Gene Name: BH3 interacting domain death agonist
  Uniprot ID: P55957
  ENST ID: ENST00000399774
  CDS Start-End: 171-758
ggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggcc

SEQ ID NO: 111528 - DNA, 700 bp, Homo sapiens
  Payload ID: 1839
  Gene Symbol: BID
  Gene Name: BH3 interacting domain death agonist
  Uniprot ID: P55957
  ENST ID: ENST00000551952
  CDS Start-End: 85-672
cactgtctgaaacagtcgcgtaaggggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggct

SEQ ID NO: 111529 - DNA, 1988 bp, Homo sapiens
  Payload ID: 1839
  Gene Symbol: BID
  Gene Name: BH3 interacting domain death agonist
  Uniprot ID: P55957
  ENST ID: ENST00000614949
  CDS Start-End: 251-550
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 111530 - DNA, 2199 bp, Homo sapiens
  Payload ID: 1839
  Gene Symbol: BID
  Gene Name: BH3 interacting domain death agonist
  Uniprot ID: P55957
  ENST ID: ENST00000622694
  CDS Start-End: 174-761
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcagattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 111531 - DNA, 542 bp, Homo sapiens
  Payload ID: 1839
  Gene Symbol: BID
  Gene Name: BH3 interacting domain death agonist
  ENST ID: ENST00000617586
  CDS Start-End: 174-542
gaaggaggaagcgcgcggggcgccataaggaggaagcgggtagtcgaccgtgtccgcgcgcctgggagacgctgcctcggcccggacgcgcccgcgcccccgcggctggagggtggtcgccactgggacactgtgaaccaggagtgagtcggagctgccgcgctgcccaggccatggactgtgaggtcaacaacggttccagcctcagggatgagtgcatcacaaacctactggtgtttggcttcctccaaagctgttctgacaacagcttccgcagagagctggacgcactgggccacgagctgccagtgctggctccccagtgggagggctacgatgagctgcagactgatggcaaccgcagcagccactcccgcttgggaagaatagaggcaggggcgtcagacaataacacagcaagtgctgaggaagaaacggaggcggcagggagcgtggcagttgagcgtggccttcatggagctgcgacagtggtactcgggcaggggcagcacggaggctgtgcgccagaggaggaggactga

SEQ ID NO: 111532 - DNA, 2236 bp, Homo sapiens
  Payload ID: 1839
  Gene Symbol: BID
  Gene Name: BH3 interacting domain death agonist
  Uniprot ID: P55957
  ENST ID: ENST00000615414
  CDS Start-End: 499-798
gaggggccgaggccagccccggagaggagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagtggctgaatgaccccaggggaccctgggagagctctgaagccctcagccaccaagtggctgggctggcaagggttcattcattcattcaacaaatacgaatgtgcagcggtgctggggtcatgatggctcggtgggcagcgaggggccgggccggctggaggagcacagtgcggattctattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggctaaagctcgatgtggtcacagctgtatagctgcttccagtgtagacggagccctggcatgtcaacagcgttcctagagaagacaggctggaagatagctgtgacttctattttaaagacaatgttaaacttataacccactttaaaatatctacattaatatacttgaatgaaaatgtccatttacacgtatttgaatggccttcatatcatccacacatgaatctgcacatctgtaaatctacacacggtgcctttatttccactgtgcaggttcccacttaaaaattaaattggaaagcaggtttcaaggaagtagaaacaaaatacaatttttttggtaaaaaaaaattactgtttattaaagtacaaccatagaggatggtcttacagcaggcagtatcctgtttgaggaaagcaagaatcagagaaggaacataccccttacaaatgaaaaattccactcaaaatagggactatctatcttaatactaaggaaccaacaatcttcctgtttaaaaaaccacatggcacagagattctgaactaaagtgctgcactcaaatgatgggaagtccggccccagtacacaggggcttgactttttcaacttcgtttcctttgttggagtcaaaaagaaccacttgtggttctaaaaggtgtgaaggtgatttaagggcccaggtcagccactgtttgtttacaaaatcaggtaactaactgcatacactttttctctttccatgacatcaagactttgctaaagacatgaagccacgggtgccagaagctactgcgatgccccgggagttagccccctggtaatagctgtaaacttccaatttctagccatacgctcagctcatccatgcctcagaagtgcatctggagagaacaggtttctaagcataaaagatgaaagagcagttggactttttaaaaattcagcaaagtggttccctctcttagggacagtcaaaaccaagtcacttaggtagtaccaaaataaataaggaaaagcttagctttagaaacagtgcaacactggtctgctgttccagtggtaagctatgtcccaggaatcagtttaaaagcacgacagtggatgctgggtccatatcacacacattgctgtgaacaggaaactcctgtgaccacaacatgaggccactggagacgcatatgagtaagggcactgacggactcatgatttcttcttaccagatgctttcctgttctttaagagtttaaaatcatcagaaaggaaaaacaaactctatattgttcagcatgcaatacataccacgctagggctggctcaattgaaagtgggcaaaagcttacaaatactaaaaagaagtgctgccgcgcagtgtggaggccactgtttggaaataaatcttcctaacact

SEQ ID NO: 111533 - DNA, 419 bp, Homo sapiens
  Payload ID: 1839
  Gene Symbol: BID
  Gene Name: BH3 interacting domain death agonist
  Uniprot ID: P55957
  ENST ID: ENST00000611040
  CDS Start-End: 92-391
cactgtctgaaacagtcgcgtaagggattctgaaagtcaagaagacatcatccggaatattgccaggcacctcgcccaggtcggggacagcatggaccgtagcatccctccgggcctggtgaacggcctggccctgcagctcaggaacaccagccggtcggaggaggaccggaacagggacctggccactgccctggagcagctgctgcaggcctaccctagagacatggagaaggagaagaccatgctggtgctggccctgctgctggccaagaaggtggccagtcacacgccgtccttgctccgtgatgtctttcacacaacagtgaattttattaaccagaacctacgcacctacgtgaggagcttagccagaaatgggatggactgaacggacagttccagaagtgtgactggct

SEQ ID NO: 111534 - DNA, 862 bp, Homo sapiens
  Payload ID: 1840
  Gene Symbol: BLID
  Gene Name: BH3-like motif containing, cell death inducer
  Uniprot ID: Q8IZY5
  ENST ID: ENST00000560104
  CDS Start-End: 294-620
atgatgttgtgtttggagaaaagagagaagagaattgaataagtacatgaccccttggaagctgttttcagttgaggattttggtgagtagccacttgaaatcaagggaaattccatgaatagcaggagctgggaagaaaggaagaggaggaaggatcccaccacttttttcttcccatctaacaccgtgcttatgcaaagcatagtccatatgagatctgccttataaaaacttgctgaataaagcgaatggaagttaaattttggactttcttccataatagcttcaaattatggtgactttgttgcctatagagggccaggaaatacatttctttgagatcctagaatctgagtgtgtgctctacacaggatggatagagcgagcctctggcagttccatttatccagaggcaaaagcacgcctgccactggaggcgctcttgggttccaacaaagaacctatgttgcctaaggaaacagtgctttctcttaaaaggtacaatcttggctcctctgccatgaagcggaatgttcctggacatgtgcttcagagaccttcctatttaaccaggatacaagttacattgttatgcaattcctctgctgaggccctgtaaaaggagtgagttaggacagatgcagcaagatattaggacagatttcgcccattattcaggctgcacaacacagaaggaaacttgatttcaataagacccaattcttaacagtcttttctacccacttttacccataacttttccaaatttggttcaaattgtgcagagaaacaataaaatttttaaaaaggataaactggctagttaaaagtaaatggcatttaattaaaacaaatcttgca

SEQ ID NO: 111535 - DNA, 3281 bp, Homo sapiens
  Payload ID: 1841
  Gene Symbol: BICD1
  Gene Name: bicaudal D homolog 1 (Drosophila)
  Uniprot ID: Q96G01
  ENST ID: ENST00000281474
  CDS Start-End: 104-3031
ccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaagacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaattt

SEQ ID NO: 111536 - DNA, 3194 bp, Homo sapiens
  Payload ID: 1841
  Gene Symbol: BICD1
  Gene Name: bicaudal D homolog 1 (Drosophila)
  ENST ID: ENST00000395758
  CDS Start-End: 81-2564
tttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaacaattttcaccttccctttgtgatcagagccgtcccaggacttcaggggcttcctacctacagaatttattaagagttccccctgatcccacctccacagaatcatttcttctgaagggccccccttccatgagtgaattcatccaagggcaccggctcagcaaggaaaaaaggttaaccgtggctccaccagattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggct

SEQ ID NO: 111537 - DNA, 8811 bp, Homo sapiens
  Payload ID: 1841
  Gene Symbol: BICD1
  Gene Name: bicaudal D homolog 1 (Drosophila)
  Uniprot ID: Q96G01
  ENST ID: ENST00000548411
  CDS Start-End: 182-2689
ctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggcatttgggcagtccttctccatccaccggaaggttgctgaagatggagagactcgggaggaaacgcttctgcaggagtcagcatcgaaggaggcttactatctggggaagatcttggagatgcagaacgagctgaaacagagccgggctgtggtcactaatgtacaggcagaaaacgagaggctcaccgcagtcgtgcaggatctgaaggagaacaatgagatggtggagctacagagaatacggatgaaggatgaaatccgagaatataagttccgggaggcacggctccttcaggactatactgaattggaagaagaaaatatcacattgcagaaactagtgtccacgttgaagcagaaccaggttgaatacgaaggcttaaagcatgagattaagcgatttgaggaggagacggtactgctgaacagccagctggaagatgccatccgattgaaagagattgctgagcaccaactggaagaagccctcgagactttaaaaaatgaaagagagcaaaagaacaacctgcggaaggagctctcccagtatatcagcctcaatgataaccatatcagcatctcagtagatggactcaaatttgccgaggatgggagtgaaccaaacaatgatgacaaaatgaacggtcatatccatgggcctcttgtgaaactgaatggagactatcggactcccaccttaaggaaaggagagtctctgaaccctgtctctgacttattcagtgagctgaacatttcagaaatacagaagttgaagcagcagcttatgcaggtagagcgggaaaaggccattcttttggccaacctacaggagtcacagacacagctggaacacaccaagggggcactgacggagcagcatgagcgggtgcaccggctcacagagcacgtcaatgccatgaggggcctgcaaagcagcaaggagctcaaggctgagctggacggggagaagggccgggactcaggggaggaggcccatgactatgaggtggacatcaatggtttagagatccttgaatgcaaatacagggtggcagtaactgaggtgattgatctgaaagctgaaattaaggccttaaaggagaaatataataaatctgtagaaaactacactgatgagaaggccaagtatgagagtaaaatccagatgtatgatgagcaggtgacaagccttgagaagaccaccaaggagagtggtgagaagatggcccacatggagaaggagttgcaaaagatgaccagcatagccaacgaaaatcacagtacccttaatacggcccaggatgagttagtgacattcagtgaggagttagctcagctttaccaccatgtgtgtctatgtaataatgaaactcccaacagggtcatgctggattactataggcagagcagagtcacccgcagtggcagcctgaaagggcccgatgatcccagaggacttttgtccccacgattagccaggcggggtgtgtcatccccggtagaaacaaggacctcatctgaaccagttgcaaaagaaagcacagaggccagcaaagaaccaagtccaactaagacccccacaatctctcctgttattactgccccaccgtcatctccagtattggatacaagtgacatccgcaaagagccaatgaatatctacaaccttaatgccataatccgggaccaaatcaagcatctgcagaaagctgtggaccggtccttgcaactgtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcagacagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaaattgtcagcagcctgctgcctccgtaccgccacagtgctcacaactagccgggaggcaagactgcccaactgtcagtcctgacacagctctccctgaggagcagccacattccagctcccagtgcgcccctctccactgtctctccaagcctcctcacccctagtcttcatctcctgtggacgaacatctggggtggaagttttgtagccacacacaggatactgcccaagatccagcgggtgttttcttctcggttgttagatgtacaattggattaatgtccatcgttttggaagacgagagaaagttgagaagaacacgaagcacagaccctgatgtgataaaacattttgtggtttctctgagtcacagataaacttctgccatcaaatggctacagttcatttaaatttaaaaaaaagaaaaaagaaacagaaaacgtgtctcagatggctggctttacctcgatagcataagagagacctaagacatgtaaaatacgtatattgcagtatcatctttcctcacactccaaattcagctagggaagttgattccaatatgtttgtcattgatatttattttgtactttatttgctacatgatttatgtctatacaaataatttctctgaggtgaatttaattcatttattttcaaataagcataatttgctcaattaagtatgagtttgaatttagtttgaaatctggaattggccagactgtggtcatttttcttgcacaaaatgataaatgaggtgcatcagaatgttaacaataactgtattttgctgctacgctggtattgtttaggcacttactttctaatcagtagctcattaactgctgggttttgtttttgtatttttaactagagttcttcactggacattactaagtaaatctaagaaagagactaagttatgatttattgacttattcaagttttgatggcatctttacttttattttttcattgcagttgagtagatgtactggtgctgctcctttgtatgtgtgtatgtgtgtgataacgttaaagaaggctcaataacttgaagggaaaaaaatggtgtgtttatttaatgaccagaattttttttacttctcccaaaatcagggtcctactgagtctttcctgataaaaggtatcaagtacaaatgggaaaatatatacatatatagatgtaagatagcctttaattaattaatttacccagagagtgttcaaagtttgattaaaattgtatgttttgttgttgttagtttttttcataacgaatcttccttgccaaaaaaacaatagataataaaccttagctcattgtctacttttgacaaacactcaggtgcctacaaacattctattatcttgagataatacatgttcctggttaatttacagattctgctgggtaacttttatgacttgatttaaggcagtggattttcatagcaaaatttattttgcacataatctgacaaacaaggaaaacagctaactgagctgaaaggtctaacactctcgggctccttaaccatcaagtgctgcccacacaattgctcctagccctgattccttgtctttgtcaggtagccttaacttatttaaaaccataagggtttgaccttttcatataaagacatctgtaacttctcttcaaaacaaaaatgaccctcactgttaacacaaaggacagttaccagtgtagggcactgagaaaggagatccaggagccactcagcttattgagcggacatgggtggcacagaaatggagtggtccatcagagaccaaatggtaagtcgtaaagcacattgcaggagctttcgttagtcatacgcctattaagtagtggtcgctattaccaaagcaaccaggacgttttgtgttctttatatgagtgctattttccacagtgtcatttattatgcaacgtggagtaaagagttgaaatcttcaccaaaataagggttcaggttaaagtacagaaacagaaacaaaacgattcgacatgaagttcccaaccatagcagcctaaccttctgctcttttctacctgcatggccttgctgttcctaaacattgtcttcatttcactggcgttgtatctgcctagtaccagtattagtgagactgtggattttatcagagttcaatgaaagaaagcttacccctgccctcactttgtgttttttatttttccccctttctcaagcaccacgtatttggacctgagaagtggcatagctgctaagttgacttttaataaaaaactgtttgtgcctgagggaaatatatgcctttttaaaaagtacctcagaacatgttcgtagatcgtctcatcggttttgtttggtgggactgggagttcagcaggaagtattgtctgtgtgtgatgacggggcagtattgccagtcggcaatgttgtatttgcattctttatccctaactctgaatctaggactccatgaaaagccgggtcacccacaaaacatttcttccaatacaaagtgtattattacgtctattataaactagtttcatttcagttatttatcttcatagagtgggaaagtctttttctgaaatactaattctatgaaaataataattttagtgaatctttgccaagaagttatagaaacttggaaataaatttctcattttcagcacaaaattaagtgatagtccctaagcagtaagagagaataccatgtatttacactgtggcatcatttagtatagtttacactgagccatatttatttataggcatttaaagtgaatcagtatgtgtagtgttgataaaaatcagtatctgtaaagataacatcaggaattcaaaaggaaattgaaaaggggcagaactagtgagaaccaaaaagaatgaactccagtaagactaattgaagacatacttggagaggaaaaataaacagcagaaatgcactaaaaaatactggctaattattgcaaacagagtgagcaaagattaatgctaactagtaaaagtagttagcaaagtaaacaggtagttttttaaaagtaagcacaattacaatattgaatagtatggagaaatgcttttctcctgaggattttccttaatcaaaaaataagaagaagcaataaattgtctttggcctgagtgctgagtggcataaataaaggagcttggcttaatctttctggtccacacataatccattagatcccattcatatatccaactctggattctaataaaataatttggagaactttgagaaaaaggaaaactgttaaataagaaaagacctatttagaaattatactttagtctaacgaagaggaggtacaatagtagtcttcaagaaaagaatatttaacaaatgatagatatcagctatagatattgttactaagtctagaataaaaaaggcttcagtgtgaaggatgtatagtaactctaggaaagagatttttaacactgggaaattaacgtggaaattgataatcataaagaatatttgttttgtaaaaattgaatatcattggtggtctagtaagtattaagtggcaagataggagaatgcatttcagttctgggagctcataatcctgtgattcttttattttaagttttaaaatacattaaaattttactggttaatcataaaatattttatatttgaaaataggatggcaatctttatttttccaagatatttgttggaaaaaaatgatcgttggtattattttttctttcagctatattccatggtatctttaaaattgttcagaatataggacttttactaaaaaaattcaattgtcagagtctaaaaaaacaatgtcctcaggaatacttcagaaatagaaggtatgcaatcccttagtggggggcaaacacatttcagatttcgtctttatttaaaaggatcttcagtctacaacatttgcttttttcgtgctttggaaaatatccttgtgcagataagttcttctgtttgaaacaagcatgaaacattggtccaataacctaagaatgtggagatttcttgatattctgtattaattaaagttctctacatgtctcaaatggagatcacaaaacatgaaaaggaagaaatgaaatatcttttcttctgggatgagtgtcaattttaatgtataattgtcataatcaatcagccaaaagttacaatctgtccctcagagacattgggggaagctgatggatttccagtaaggaactgtggtgggttcaaactcaggctgccacaaatacattgatatggtaggtaggaagtaggactaaatttgaaagaaacttatgggataaagttcacaattttaaaaaggttgccctccagtttttttgtttgtttataaactagagtgatttttaagtaacccttatatttaaggctgcaaaaaatgtacaagagtatgttttcaagtaaagggaacataattcttcaaaaagctgttgaactggagttatgataggttatgacagagagcatgatcagtgctgatactgacaagtacttttttaccttaaaatcaacttctatggaactacaagatcaatctagctcccgagtgacattttccattgtctgtaataatgccctcggatgagttgtgtctaaaattaagttcatctttatttatatgcgaacttaactgccatagtccctaatgtattgcgtttgtaacctgatcgtattatgtttacagctgaaagatttcatctagacatgtctttcgtccttattattcaaagtgtaattgaaagagatatttagtattaagacatgttccccaattgagaattttccagaatattctacttaagaagaagaagagcaattaactgcctttagtgtaagggcgagagtgcatagaaatatgcaatgtaaaatgtttgcatgaattatttcacatcatgtaagctttcccatattcataagatgaacactatagaagtctcatttctctgtgatcttctgtccattaggaaagtaaggagattgttatctatatctagtctcctttccatattgaactgcatggctctaatcctcagtgtatttttatcccttctcgagttatttaaaatttgccctatttaagctgaagcctggataaactgctgagccagattattcctgtgattggagtttaattgctgtagaacacttgttgagaacacattttttactttttttctttcagaattattcctcaatcattgttctctaatgaaaacaccgagaagtaaatctggtgcttcttagtgtaaatatgtttttctttttaaaaagtcattttaaaacaaagatgagagaactataaagtaaggggaaatatcattttatttaaaaataattattcaatgatagataatggagatacagaatgactcattgggttcataggtatgatttgtgcagccagtcttagaggaaatacatcattttaacattattcccacaaaatgttaaagctcaatggtttgactatgagagtcaaacaattactatttgaaaatctcttatgacatttttataatctactctgtttttatttgcatgattatgcttatgtgatgaaccatccatgattctgatattgtatttctttccagtattaacatgtgtattgtgtggccaactctgatttgtacaccgtattattgttgtaatgattcaactgttcctacatttaattgcagtttaattattatgccttttggggttaaatgatgtgaagtgtttccacctactgataaataccatatgaaaacacgactaaaagactgatttaagaaacttgttatttttaaaaatatgaatttcaaaagaaatgttctcaaagacacatgcatttattttaaattcaaaaaattcttatgaatttattattgcttgtactttaactttttttattgtagacaatcctaagtgaataatgtctcatgggagaacacatgatatgtgcttgtatttgtgtaatctgatcatgcactcaatggttggaaaaggcactccagtgctaagaaaataaccagaagccaatatatcgattcttatatctcggtttatgttaccaactgaatatggtgtaatgcataactttttccagtaaataaactggttattttttgttcatttca

SEQ ID NO: 111538 - DNA, 423 bp, Homo sapiens
  Payload ID: 1841
  Gene Symbol: BICD1
  Gene Name: bicaudal D homolog 1 (Drosophila)
  ENST ID: ENST00000551086
  CDS Start-End: 37-318
ccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagagggccctttgttgttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaactaggaatct

SEQ ID NO: 111539 - DNA, 1328 bp, Homo sapiens
  Payload ID: 1841
  Gene Symbol: BICD1
  Gene Name: bicaudal D homolog 1 (Drosophila)
  ENST ID: ENST00000550207
  CDS Start-End: 448-687
ggtggagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataaaaccagaatatcaaaaatgggtgat

SEQ ID NO: 111540 - DNA, 1962 bp, Homo sapiens
  Payload ID: 1841
  Gene Symbol: BICD1
  Gene Name: bicaudal D homolog 1 (Drosophila)
  Uniprot ID: Q96G01
  ENST ID: ENST00000551848
  CDS Start-End: 498-779
ccccgagactgcatcattccgcaccggctgctgcagggccagagggagcaggtggagcgagagagcgagccgcgagccggagcgcgccagacccagggcgagactgcagtgacgcggcccgggagacatggcggacgggcgtctctgaataagcagaatccggagcccctcgctacccgcggccgccgcagcccgggccatgccgcacggctgctgaccgcacgcaggggccggccccgaggacacatgcggcggcctttgccgcctcgcccctgaccctctgccctgttctccatgttgcatttctcgtcagtttctcgggcggtgtagctgccgctgccaccagagccggcggggcatcgcgctgctcattcatccggccgcactttcttttccgtttccacccatcccttcccatttccttctccctttccccgccagcttcgcatccatctcccccaccccgtaaccccctcctgcctccatccaccggggctatggccgcagaagaggtattgcagacggtggaccattataagactgagatagagaggctaaccaaggagctcacggagaccacccacgagaagatccaggctgccgagtacgggctggtggtgctggaggagaagctgaccctcaaacagcagtatgatgaactggaggctgagtacgacagcctcaaacaggagctggagcagctcaaagaggtgagttgcctgtcacctctccctttcctggccctcactccccccacccgcaaggcccactcatcatgatcaagaagtcataaaggaggtgattgaaaggactgttttttcttctagggccctttgttggtaagagaagattgaaagagtccattgtttcctcccccaagagaaaaattgcctaagaaatgaatatataagctggaatttgggaggcaatggctgtttggcctgcgggggagggagattagtaagagtcatcaagtctcagcactctaagacgacattcaagtgggttggaatgtataaatcaaacttctcaaaaccgctgttatctcaaacccaggtttcagcgacaatttcgtagtccacaaaagtgatgaggtttgtgcctgaggacccacaatttcaggatttagactgtgtggcacctcagctttcctctggatgtaaccactccttggtgagagagggaactcctcaccaatcccatttgacaaaggctaggcaatcttcattctgcttggctttagtcattcttgtcattgggctgcagaagaaaaacaactttgctgggtgatcccactgccttgatttcacctcggagcgaggctgggccatgtccaagtcttatgaggtcaccctgactagaaaaaattgaactcacctacaaatagtctgaaagagtggtgtatatcaaatacgtgggtagtgttgcatttcaaatgaggctcttctggttgaaatgatatatttataaaaccagaatatcaaaaatgggtgatgtataatgtctctttagttttttggtatttggcctcttttaaagcctgtcggatgtatgggagaaaacaatgaacgtgctttgatttcctatcagtcactcttaagaacatacatattgtttaagtaactcggtcttttttatctgattcttgaggcactatgggtagcaaataaccacttacaaatttaaatgtaatatacactccttttctgtgtgtcaagtccttatttttaggtgcatattgacatttaaatgttaattattgtttggcatataatatcaaaaatctattatttattttatgctgttacagttaaaagatgtgatttatgacatactgaatcaacttgccttccaatttagtgtgtaatatggtaagcatttatacttttagatatgtcttatttttatttggatgcctgtctaccaaaaaataaatgtactacctatgattaaaaatcccaa

SEQ ID NO: 111541 - DNA, 766 bp, Homo sapiens
  Payload ID: 1841
  Gene Symbol: BICD1
  Gene Name: bicaudal D homolog 1 (Drosophila)
  ENST ID: ENST00000547680
  CDS Start-End: 1-208
gtctcgtcaaagagcagcggctcgggagctagcccccatgattgataaagacaaggaagccttaatggaagagatcctcaagctaaagtccctgctgagcaccaaacgggagcagatcgccacattgagggcggtgttgaaagccaacaagcaggcacagtgccttctgatgaagtcagtaaatgcttatgaagcaccgtccatctagcactgtgctagatgctgaagattcaaagaagactaacacatggtccctgccttccagaagactcagcctcctggggatgtcaggatagaaacacaattacagttcaacgttacacatgctgtaatccaagttatgagaacaatgcagaggaagcaactaaggtttcctagaggagcggaaaagacttcacagaagcaattataccttagtttgttattaaaggataagaagttgttttccagaggaggaggaagtaattccagacagaacagtaggtagagaggctttggagtgacaaaatagaataatatattcagggaatgctcacaaaggcctatgtggctggaaataagactttttttatttagaaagtcaactttggaatgtgtggagaaagtggtgaaagcagaaatcagcaaatccagtgagttatggatacttaaaattacttaattctggaaaaactttgcacagtcaatggacaaacaaatctacaaacaaaactgaggctttggggtatttgtcacaaacaataaatgattttgtatttctgtttca

SEQ ID NO: 111542 - DNA, 1583 bp, Homo sapiens
  Payload ID: 1841
  Gene Symbol: BICD1
  Gene Name: bicaudal D homolog 1 (Drosophila)
  ENST ID: ENST00000552160
  CDS Start-End: 1-521
cagctgaggtggcgctagctaatctcaagaacaaatatgaaaatgaaaaagcaatggtgactgaaaccatgacgaagcttagaaatgaactgaaggctttgaaagaagatgctgcaaccttctcatccctgagagcaatgtttgcaacaagatgtgatgaatatgtcacccagttggatgagatgcagagacagttagcagctgcagaggatgagaagaagactctgaacactttgttacgaatggctatccagcaaaaactcgccctgacccagaggctggaggacttagagtttgaccatgagcagtcccgacgcagcaaaggcaaacttggaaagagcaagatcggcagccctaaagtaagtggggaggcatcagtcaccgtgcccaccatagacacttacctcctgcatagtcagggcccacagacacccaacattcgggtcagcagtggcactcagaggaaaaggtatgcatgcagcgatcttcatagtacggtgcagtggccagattttagttaactgcaaaaataaatgtgctcttgttgtggaggatggaggaggggaagcaaaagaaaaaatgggagctggcatataaatggtcttgctaatgtgggtctttccagatcaaaacctttttgataattgtgtttatgtagtcctttctaaccccctgcccaatccctcctcttgattaatcgtaatataattttcaagtgtctgttaatatttttgctactctttgtatgtgtaaatatgcctctcccttacctccaacctgagaattggtagataaaggtggatattaagaatgaagctgtgttctacctgggttataattttaaaagtcattgtacctttggaaatggtgctgtttatcagcttctctttaacggggcaaggatatgaatatgttctcttagggaaacttttgtccatatgaccaaaactgatgacagactgaaaggggatgtctatatctagataaaatgggatggaatacgcacagtccttttcttgaaagcaggtttttgtgctttttcatttggcatgggaatattgcccagagaaaccacttgtaaggtttttaggggcttgattttgtgagtcctggctgttgagttacttaccctgtattttcggttaatggtaacatttttattttaggagctttcattaaagactcaaataatatattttctatttgcggttcaagctgactaactgtaataaatcttttttccagtatccagaacagtttccaaatagggttgtatcctgatgtggaaactaaaaaaaaaaaaagcaaaaagattgatttacatatttaaaaaattaaatgccagtataaataatgttgtcactggtgaggcgttaaaaggtaattaaagtaaaacttttttgtttcctatatgtatttttcttggatctcctgcaagacaattttcaccttccctttgtgatcagagccgtcccaggacttcaggggcttcctacctacagaatttattaagagttccccctgatcccacctccacagaatcatttcttctgaagggccccccttccatgagtgaattcatc

SEQ ID NO: 111543 - DNA, 6427 bp, Homo sapiens
  Payload ID: 1842
  Gene Symbol: BICD2
  Gene Name: bicaudal D homolog 2 (Drosophila)
  Uniprot ID: Q8TD16
  ENST ID: ENST00000356884
  CDS Start-End: 69-2636
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcgtaagtcacacctgtgcctgtgccagcgacagggccgagggcaccgggctggccaaccaggtgttctgcagcgagaagcacagcatttactgtgattaggggctgtggggcgccgcacgctgcagctaacatctgcttcacctcaactaacccagcagcagcgggacggcggtgctaggtcaatcttaacgtgactaatgcacagagggtaggagtctagccgaggcgccatggggcgttgcatcagcaggacacttgtgagagctttgtgtcgcttctcactcctcaaagccccctcaggagcacccagtcctcagctgctctcttaggtgggggtcagaggtggggatagagctgcacattcttgcagcagatgtgtgatgaaagcatcttctaagccctgcgcacccgtggggaaacccaagggaggagtcctggtcctgctccctcagcacccaaaaggggcagaacctgagttgagacttgcatgttcctcgcatgtgtctaatgtcagcactagaaagcagttttaggaggttccagcctgcagcataggtacgacctcagaggatggctttgcacttggcatagtttcatggaaaggagtacgttgtagtttatgcagtatctgactgcaaatcatattcaggaaagaagtgcagaatttcttccccaagcccagagaagagcagccctgagcccctgtattctgctggccagacacacatggcacagacacagctgaccataacccaggaatccagagctcggtttctcatttctgagatcaggatgcttgtatagtggcctgtgaggtgacagattggcagggcccaaggccccaggttttcatttttcatgagaaaagctttccaagtgcctggccagaccttggtccttagtgcagagcccgtccttttgtacttggggtgaccccagcagccaattatccggccttccatagggggttcagtcccaaagacatggggctttgaaaaccctagcctgaagtctgagccaccaagggcttggctgggttggacacccacaggtgtatccagagcccagcccggtgctgggaaagctttgcatagggccagggccacttgtcaggattcacaggtaggagatgtttaggtctctttatttagtgcaatctgggggatggcaacagagaaagaggaaaggtagctgtagggttctcccatttccagaggctccatccacacctgccttcccacattctgagcagaacttttctcagtacttttttcccgatcaccctgtgggaccagctggacctgaggctgcagtcttctctcctgcaggctgcttgccttgtctctcatgcggaagaggcattcgagttacctggtgagagaccgtgttgccccctcccacagctctctgccctgcgcgttcttccctttggtgccgagtatgtttcggtcccctccagactccaggacacgcccatgtatgtcccctgcgtgttcatcctgggcccagatccccctgccccagcaagactcgcagtgggatggctgctggcatgcccaccctgcatgcgctttgccctctccttgcaagcctggcacatagcttctctccatactcctaagggactttgcagacacccaagccactgggacccctgctaacacatgcaggtcttctcttctgccaactaacgtgctcgcgccctcccagcacgtggagagcttcaattgtcagataaacaggaagcgacagatgaccgctttctaacgctctcttttctcccgttttcagctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 111544 - DNA, 4636 bp, Homo sapiens
  Payload ID: 1842
  Gene Symbol: BICD2
  Gene Name: bicaudal D homolog 2 (Drosophila)
  Uniprot ID: Q8TD16
  ENST ID: ENST00000375512
  CDS Start-End: 69-2543
gcggcggcggctgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtggactatgaggctatccgcagcgagatggagcagctcaaggaggcctttggacaagcacacacaaaccacaagaaggtggctgctgacggagagagccgggaggagagcctgatccaggagtcggcctccaaggagcagtactacgtgcggaaggtgctagagctgcagacggagctgaagcagttgcgcaatgtcctcaccaacacgcagtcggagaatgagcgcctggcctctgtggcccaggagctgaaggagatcaaccagaatgtggagatccagcgtggccgcctgcgggatgacatcaaggagtacaaattccgggaagctcgtctgctgcaggactactcggaactggaggaggagaacatcagcctgcagaagcaagtgtctgtgctcagacagaaccaggtggagtttgagggcctcaagcatgagatcaagcgtctggaggaggagaccgagtacctcaacagccagctggaggatgccatccgcctcaaggagatctcagagcggcagctggaggaggcgctggagaccctgaagacggagcgcgaacagaagaacagcctgcgcaaggagctgtcacactacatgagcatcaatgactccttctacaccagccacctgcatgtctcgctggatggcctcaagttcagtgacgatgctgccgagcccaacaacgatgccgaggccctggtcaatggctttgagcacggcggcctggccaagctgccactggacaacaagacctccacgcccaagaaggagggcctcgcaccgccctcccccagcctcgtctccgacctactcagtgagctcaacatctctgagatccagaagctgaagcagcagctgatgcagatggagcgggaaaaggcgggcctgctggcaacgctgcaggacacacagaagcagctggagcacacgcggggctccctgtcagaacagcaggagaaggtgacccgcctcacagagaatctgagtgccctgcggcgcctgcaggccagcaaggagcggcagacagccctggacaacgagaaggaccgtgacagccatgaggatggggactactacgaggtggacatcaacgggcctgagatcttggcctgcaagtaccatgtggctgtggctgaggctggcgagctccgcgagcagctcaaggcactgcgcagcacgcacgaggctcgtgaggcccagcacgccgaggagaagggccgctatgaggctgagggccaggcactcacggagaaggtctccctgctagagaaggccagccgccaggaccgcgagctgctggcccggctggagaaggagctaaagaaggtgagcgacgtcgccggcgagacacagggcagcctgagtgtggcccaggatgagctggtgaccttcagtgaggagctggccaatctctaccaccacgtgtgcatgtgcaacaatgagacacccaaccgtgtcatgctggactactaccgcgagggccagggcggggccggccgcaccagtcccgggggccgcaccagccccgaggcgcgtggccggcgctcacccatcctcctacccaaggggctgctggctcctgaggcgggccgagcagatggtgggacgggggacagcagcccctcgcctggctcctcactgccatcacccctgagtgacccacgccgggagcccatgaacatctacaacctgatcgctatcatccgtgaccagatcaagcacctgcaggcagccgtggaccgcaccacggagctgtcacgccagcgcattgcctctcaggagctgggccccgccgtggacaaggacaaggaagcgcttatggaggagatcctcaagctgaagtcgctgctcagcaccaagcgggagcagatcaccacgctgcgcactgtgctcaaggccaacaagcagacggccgaggtggcccttgccaacctgaagagcaagtatgagaatgagaaggccatggttaccgagaccatgatgaagctgcgcaatgagctcaaggccctcaaggaggacgcagccaccttctcctcgctgcgtgctatgtttgccaccaggtgtgacgagtacattacacagctggatgagatgcagcggcagctggcggctgctgaggacgagaagaagacgctgaactcgctgctgcgcatggccatccagcagaagctggcgctgacccagcggctggagctgctcgagctggaccatgagcagacccggcgtggccgtgccaaagccgccccgaagaccaagccagccacaccgagcctgtagagtagctgccaggaggacttggccacccggccctgtcacactgcagccccttccccttccctctcgtggcccacaaggaggaaggaagggcaacctaaaagcccacttagaaactttttggatatgccactgcaattcttttcaaaatagcattccccaggtttttaatgggaggaaaaaaagctttaatgttgagcatgctgcgagctgctgcgtggaaaggcctctgtatgggccgaagacccttcttccctggctgccaggctcgccaggagcccactggaaacgcccaccacgggggctccttgttacacatgttctttttttatccgatcaacctgtgcacttttgatattttgatattatatttgcttccttaattcctcgcgtagagacggtctcaggtgccgtggtctatgctcgtggtcctgtagctgtccgcctcagctcccaccgtgtttgtctggtgtcagcacgaggcagagctgtgtgctccatagcgtgtagctttagactcggagatgagtgctttgacccagcgaggagctcagctaagtgtatccacgctgtggttcagcagcctttagatcatacggcattgtggttcatgtttgaaattacagattttaaatgccatgttcattaagaaatccagggtattcagattctggggtttttcatattgtattattattattcttaggaatagttcaatgtaacaagaagaaaacttgacctttgctctggttaaaacagtaataggcacttgaaaaaaaaagataaattattgaatgagtagtattacctacaaattccagaattttctgggttttaggacgttgtgaagcatgactgattaacagaattttatacaactgtaccaataaaattccaaattggaattgttttgttactctggttgttgtgccaaattgtggtacacttagaaaattctacagtcgtcgatttttagggtgttctctttcaacacctttttgttagtaatcattgccagtagtgccttcatcagttaagggaggtgtcccagcacagatcattctcaaaagcgagcagggaagagctagtgggcatgctgaaggccagcgtggacagcaggtgaggcaggtgctcctcacacccagacctgggcatcttcattgagggaaagaaaacagtcattgtgcaaaattctgttagtcagtgattctttacttgcaaattcaggggcttagaaaatgaaagcaaacacaaaaccttgagtgtgctttgggaaccaaatggaccttctgggacaagctgagcaagctgtatgaacgccacgtttgtgaagagctgagggtatcaggagggccgacgctgtgttggcatgcgcagtaggggatgagggttagccatagtattctttgcaaatgtgaaagcgagacattatatcttctcttgcttggtgtaactaatcactgttaatttcaggaaacagaactcattaaaactccttagcaaaccaggtctacatcctgttttgtttgctgagtgaggttagtgggagtggtcaaattggtactcttggaggaagaaaaactgtccttccttctccaaaaaaggaaaaattataataatataaatgacaaaaataaaagaattctgtttcctggaataagcatttcttattcctagttgtagggactcctatttttaccttccgttacagtgttgattcataagaaatattgttacatttgagataacttcatctgtatggggtatttatttgcaatgatgtctgagtactgtattttttctgtgcattaccttagtgtcagaatgttggtctttattttaaagtcatatgcatgttctcctgccaaggaacctttacacagacccaaacaaaaaaataataatcaaatgccttcaatttctgagaaaatgaggcagagcatggaaaaggaataggaaggagaaattaattgagattttcaggacacagacatatgatgtgaatgcctacaaagccagtgcgcataggaacagtgggcctgggtaaagagtcacattggtaggaccaataaagaataataaaaagacaaagcaca

SEQ ID NO: 111545 - DNA, 1763 bp, Homo sapiens
  Payload ID: 1843
  Gene Symbol: BICC1
  Gene Name: BicC family RNA binding protein 1
  ENST ID: ENST00000263103
  CDS Start-End: 25-1545
gatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagcgttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtc

SEQ ID NO: 111546 - DNA, 5475 bp, Homo sapiens
  Payload ID: 1843
  Gene Symbol: BICC1
  Gene Name: BicC family RNA binding protein 1
  Uniprot ID: Q9H694
  ENST ID: ENST00000373886
  CDS Start-End: 5-2929
caccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaagctgctgctgaagggaaaggcagaagtggggaagacttttttcaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcatacagaacaccaaatatggattacttttttaaaatggcagttggacagaatttgcaatataaggatagggctttatttcctgtttttatttacctatataacatatgcactgatgatttttttttttttttttttttttttttttttacttaaaatgaaggatgaattgacatctgggatgccagaagacttagaagttattttgtttgcttgttttgtttgggtatttggggatttttaaaaaataatcaaagtggaattttctggtactgctttaaaataattattgtggtctttcagcactttacacgttctaatttcttgtcctatggaagttctcgctgtctccatctctctcatttttgtgtcacctaatatgttggtacagataagagttagtcacatttttctgactgcatcaaacttttatttgaaatggtactggatcttagtttctgtgcagaatattctgtgattttgggaaatgtaagtgagtccacttgcttctggaccaattctgtttcatgtatgttagcatcctagaaacacctagcaatggacctagttcacagtaataggtgcaaagaaagaccaaatggactttgcagtattaaccctttgcagtcgtcatacttagctgctgcctgtaatgctaaaatgattttaatggttgtctggaggcaaagggctgttttttagtatattgccactaaaggacatttatttatatcaaacttttatttttagatattataagcatacagtacataattgatgaaattgatatttactagagatttatggtagagaatggacgacattcaataactggagcccgagattgtcactttatttaaaaagacaaataatcatctgacaagacagcactgttgccattataaggagaaatagattacaatccttatcatgtacacgttagctatgttccgtatggccacaggactttcctgaaaccgtatctgtctgcttgaagtagacttatgtttgttgagaatgaacaggcttatttgagcctccagggtggcagttcataaagacagctaagttctgaaggaaaaaaaaaatatatctttttaagtggctagagtcattattacaatcttatactgtgaaagtccaagaaatcaggcaacattgtttcctgggtcttttcagagatcttatagatttatgaagtgtttttaatccatgaagaaacactaaagtgcctttctttcttcaaagcaatattatttccaagtatattaatttgttagaaaactttcccataggaaatgttgtcaagttacctgtactgtaaagagttatttatgttcagtagtcaagattttctacatggacataaaccactctcacgtgctctcagcagaaggcattagataagcatatacaagaattgggtacttttatacaaatatgggataagaaatacttgcctgacacttttccatggctgagtctgaccattacagtaagaacaagaattgaagaggcattttgcacacagaaacattctcactttaaaaaatggtattggttaccttgaaggcatagataatgggcctgtcataaaattatcaattataactggcaccgagggactgccctttttaagctaaactaagccttatctgcttaaggatgttgaactgaatcactccctttactcatcctgtgcatatgtgtacaaatggtcatgtggatcatgtgatgatcatccatcttatttgattgtattaatgcatcatgctaaacatgtagtacaggttaacaataccagatttatgtcctgttcaacaactcagtactctaaatgttgttatgcttttaataagaccttcccagataataatcttggagctcttttcccagctgtctaccatgcatttgcaacaggaggaagatgtaatgaatatgcagtattaagttgatttatgaacagtgctttgatatgccaaagggaaaactgtcccacttaaattagattaagtagggtggctaaaaataaataaaaacactggaaattctttctctcactttctcttgatgcaatgaagggaatatgacactacagtatacagagttgttgttatatgatgcacaaaatattttgatgatttgaataaatgttaacttttaatctgcgccttaataatgactggttatctgtaaatatagaacagatacagattgtatttttctgtgggtttttgtccttttagtgatttttttccaaaaacgagagatggaattaacattgaaaatgggaaatttttctaactgaatcaattgttacatgaaaaataaatttatataacccctttgtattgctcttgctata

SEQ ID NO: 111547 - DNA, 3039 bp, Homo sapiens
  Payload ID: 1844
  Gene Symbol: BFAR
  Gene Name: bifunctional apoptosis regulator
  Uniprot ID: Q9NZS9
  ENST ID: ENST00000261658
  CDS Start-End: 278-1630
gtggccgctctaggcagcggggaggtcgcggggttgaggggggttgtgaaaggagagcggcctctcctctatggtcacggggccggggcacgcttcccccactctgtcttgttacttccggtagcgaagcctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcagggatgccattgaaaagttatttcctgatgccattagactgagatttgaagacattcagcagaataatgacatagtccaaagtcttgcagcctttcagaaatatgggaatgatcagattcctttagctcctaacacaggccgagcgaatcagcagatgggagggggattcttttccggtgtgctcacagctttaactggagtggcagtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggttgcttttaactttgacagaggaagaattttccaagacgccctataccatagaaaacagcagccacaggagagccatcctcatggagctagaacgtgtcaaagcattaggcgtgaagcccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccacccagccaccttcctcacagggactaggaggctcagtccccaacggctggcaagactcagggtcctcagtggacatggtgtgggtgacatcagaagggtgccacatcagtcccctccccaacctcagtgactgacagaggatccggatctcagagcctgagaccaggtttattggggcctggcctgtcctctaagtcaagtttaggaaaacaaggataagattctgtcataggcatagagagttgcacataaaaaataccgaagaaaacccaaaattcaatcaacaattctgtcttattgaagagttgctaggattcagagtaaaactcaaaggattcagtttgagcctagaatgatggttagacttgtagtcactgggcttttgttttgctttatggaaatcattgaaggtctggatccctttctctgaatggagagattgagagggatgtcgggcagttcccattagatttagtggccttcatgttattcagaattgttttggtgatacctcacccctgtaatcccagcactttgggtgggtgaggcaggcggatcacttgaagccaggacttcaagaccagcttggccaacatggtgaaacctcatctctactaaaaatacaaaaattagccaagtgtgatggcacatacctgtaatcccagctacttggaattggaaatcgcctgaacccaggaggcggaggttgcagggagggagactgcaccactgcacttcagcctgggtgacagagggagactctgtcttaaaaaaaaaaaaaaaatcatctgtaaaataaattccgggatagtcgttttgttcaaggaaatgttttgtaaattgagctcacactatataatctttattgtcctatcctgatgtataatacagcaggtataattacaccaagcgctatagttataaatatggcatgaagtgaactatggccttttatttccttccagtgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaaaccta

SEQ ID NO: 111548 - DNA, 1662 bp, Homo sapiens
  Payload ID: 1844
  Gene Symbol: BFAR
  Gene Name: bifunctional apoptosis regulator
  ENST ID: ENST00000563971
  CDS Start-End: 162-1139
tccggtagcgaagcctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggttgcttttaactttgacagaggaagaattttccaagacgccctataccatagaaaacagcagccacaggagagccatcctcatggagctagaacgtgtcaaagcattaggcgtgaagcccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccacccagccaccttcctcacagggactaggaggctcagtccccaacggctggcaagactcagggtcctcagtggacatggtgtgggtgacatcagaagggtgccacatcagtcccctccccaacctcagtgactgacagaggatccggatctcagagcctgagaccaggtttattggggcctggcctgtcctctaagtcaagtttaggaaaacaaggataagattctgtcataggcatagagagttgcacataaaaaataccgaagaaaacccaaaattcaatca

SEQ ID NO: 111549 - DNA, 415 bp, Homo sapiens
  Payload ID: 1844
  Gene Symbol: BFAR
  Gene Name: bifunctional apoptosis regulator
  ENST ID: ENST00000564078
  CDS Start-End: 1-309
ctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagtaagtatgttttaatggttgtcacaacaggggatgggaaagaaataccaagtgagagaaagatcctcttttatttctcacacttgaaataaatcctccatccacccaga

SEQ ID NO: 111550 - DNA, 706 bp, Homo sapiens
  Payload ID: 1844
  Gene Symbol: BFAR
  Gene Name: bifunctional apoptosis regulator
  ENST ID: ENST00000563313
  CDS Start-End: 119-388
ctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactct

SEQ ID NO: 111551 - DNA, 722 bp, Homo sapiens
  Payload ID: 1844
  Gene Symbol: BFAR
  Gene Name: bifunctional apoptosis regulator
  ENST ID: ENST00000570219
  CDS Start-End: 395-722
gcccgagtcctgagcatccccactcctggccgcggggttcggaccccagcttggccaactgcgctatcccttcccgagagccccacgtccgcacagccggtcgctgggcctcgcctgcgtcctttcgggggtcagggtcagagccactccctcctggggctccctagggcgggaaggaggaggggtcgcttccaaacaccttggaggggaaccacggggcgcctgcccgccaggagcgcttgccacaccctgcaacagccggaccagaattgatgaggcttctgatagtcgccacgctgagtttacggtctaattgtcgagattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcagggatgccattgaaaagttatttcctgatgccattagactgagatttgaagacattcagcagaata

SEQ ID NO: 111552 - DNA, 629 bp, Homo sapiens
  Payload ID: 1844
  Gene Symbol: BFAR
  Gene Name: bifunctional apoptosis regulator
  ENST ID: ENST00000562545
  CDS Start-End: 1-619
gggagggggattcttttccggtgtgctcacagctttaactggagtggcagctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgc

SEQ ID NO: 111553 - DNA, 438 bp, Homo sapiens
  Payload ID: 1844
  Gene Symbol: BFAR
  Gene Name: bifunctional apoptosis regulator
  ENST ID: ENST00000565478
  CDS Start-End: 1-294
gacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaatgtgaacacagcaggtgtgagatgtcatcttggaagacaggccttgcagaaataggcctacatccaaaatattatcttgtgactccatgaaccattcattaaccctttgtatctttgagtgaaaattttactcaaaagttgcatctggaagttcgaagaaattacttgaaataaaaataaagatttctatatagataaa

SEQ ID NO: 111554 - DNA, 1448 bp, Homo sapiens
  Payload ID: 1844
  Gene Symbol: BFAR
  Gene Name: bifunctional apoptosis regulator
  ENST ID: ENST00000566710
  CDS Start-End: 60-485
gcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcaggtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggttgcttttaactttgacagaggaagaattttccaagacgccctataccatagaaaacagcagccacaggagagccatcctcatggagctagaacgtgtcaaagcattaggcgtgaagcccccccagaatctctgggaatataaggctgtgaacccaggcaggtccctgttcctgctatacgccctcaagagctcccccaggctgagtctgctctacctgtacctgtttgactacaccgacaccttcctacctttcatccacaccatctgccctctgcaagaagacagctctggggaggacatcgtcaccaagcttctggatcttaaggagcctacgtggaagcagtggagagagttcctggtcaaatactccttccttccataccagctgattgctgagtttgcttgggactggttggaggtccattactggacatcacggtttctcatcatcaatgctatgttactctcagttctggaattattctccttttggagaatctggtcgagaagtgaactgaagaccgtgcctcagaggatgtggagccatttctggaaagtatcaacgcaggggctttttgtggccatgttctggcccctcatccctcagtttgtttgcaactgtttgttttactgggccctgtactttaacccaattattaacattgatcttgtggtcaaggaactccggcggctggaaacccaggtgttgtgactggcactgcccaggctgagactcttcaagtcccgctgacgtctgagctttgatgcttaagaggggtgaggcagggagcggacttcctattttctaccctcagtaaaacaaggtgctgctttgtatatcaaaagctccaaccatgtcctctccccctcagcctgtgggtggcacgagcaaggactgacatccgcacagggaggattgtctgtttggctgacacagcagcagcccttcccac

SEQ ID NO: 111555 - DNA, 3039 bp, Homo sapiens; identical to SEQ ID NO: 111547
  Payload ID: 1844
  Gene Symbol: BFAR
  Gene Name: bifunctional apoptosis regulator
  Uniprot ID: Q9NZS9
  ENST ID: ENST00000619034
  CDS Start-End: 278-1630

SEQ ID NO: 111556 - DNA, 1414 bp, Homo sapiens
  Payload ID: 1844
  Gene Symbol: BFAR
  Gene Name: bifunctional apoptosis regulator
  ENST ID: ENST00000562442
  CDS Start-End: 161-802
ccggtagcgaagcctctccctcttcctctgctcccgcggggtctgtgctgagaataatggcccggttggcccgggacgagtggaatgattaatgatgttttgcagcagttttctacgtctgaaattttttatgtctctggaacccagaatttgctaagagatggaggaacctcagaaaagctatgtgaacacaatggaccttgagagagatgaacctctcaaaagcaccggccctcagatttctgttagtgaattttcttgccactgctgctacgacatcctggttaaccccaccaccttgaactgtgggcacagcttctgccgtcactgccttgctttatggtgggcatcttcaaagaaaacagaatgtccagaatgcagagaaaaatgggaaggtttccccaaagtcagtattctcctcagggatgccattgaaaagttatttcctgatgccattagactgagatttgaagacattcagcagaataatgacatagtccaaagtcttgcagcctttcagaaatatgggaatgatcagattcctttagctcctaacacaggccgagcgaatcagcagatgggagggggattcttttccggtgtgctcacagctttaactggagtggcagtggtcctgctcgtctatcactggagcagcagggaatctgaacacgacctcctggtccacaaggctgtggccaaatggacggcggaagaagttgtcctctggctggagcagctgggcccttgggcatctctttacagggaaaggtttttatctgaacgagtaaatggaaggtgaggagcaaagtcttctgacacaccgtggacattttagaaaacagctttcttgagatataatccaggccaggcgcggtggctcacacctggatcccagcactttgggaggccgaggcggatcgatcatttgaggtcaggagttccagaccagcctgaccaatatgatgaaaccccatctctactaaaaatacaaaaaaaaaaaattggccaggcttggtagtgcacaccttgtaatcccatctattcgggaggctgagacaggagaatcacttgaacccaagaggtggaggttacaatgagccaagatcatgccactgcactccagcctaggcaacaaggcaagactccatctcaaaaagagagagagagagatgtaatctacataaaattcacacgtttgaagtgcacaatccatggtttttaatgtgttcacaaatagtgtgattatcaccacagctggttttagaacattttcatcaccctaaaagaaagcttttacccttcagtcaatcctcatttctccccaacccccagcccctggcaaacaccattctactttctgtctttatggatttgtctattctggacgtttgatataaatggattcatacaa

SEQ ID NO: 111557 - DNA, 1662 bp, Homo sapiens; identical to SEQ ID NO: 111548
  Payload ID: 1844
  Gene Symbol: BFAR
  Gene Name: bifunctional apoptosis regulator
  ENST ID: ENST00000632391
  CDS Start-End: 162-1139

SEQ ID NO: 111558 - DNA, 706 bp, Homo sapiens; identical to SEQ ID NO: 111550
  Payload ID: 1844
  Gene Symbol: BFAR
  Gene Name: bifunctional apoptosis regulator
  ENST ID: ENST00000631407
  CDS Start-End: 119-388

SEQ ID NO: 111559 - DNA, 1414 bp, Homo sapiens; identical to SEQ ID NO: 111556
  Payload ID: 1844
  Gene Symbol: BFAR
  Gene Name: bifunctional apoptosis regulator
  ENST ID: ENST00000632966
  CDS Start-End: 161-802

SEQ ID NO: 111560 - DNA, 1448 bp, Homo sapiens; identical to SEQ ID NO: 111554
  Payload ID: 1844
  Gene Symbol: BFAR
  Gene Name: bifunctional apoptosis regulator
  ENST ID: ENST00000631651
  CDS Start-End: 60-485

SEQ ID NO: 111561 - DNA, 629 bp, Homo sapiens; identical to SEQ ID NO: 111552
  Payload ID: 1844
  Gene Symbol: BFAR
  Gene Name: bifunctional apoptosis regulator
  ENST ID: ENST00000633638
  CDS Start-End: 1-619

SEQ ID NO: 111562 - DNA, 438 bp, Homo sapiens; identical to SEQ ID NO: 111553
  Payload ID: 1844
  Gene Symbol: BFAR
  Gene Name: bifunctional apoptosis regulator
  ENST ID: ENST00000632031
  CDS Start-End: 1-294

SEQ ID NO: 111563 - DNA, 415 bp, Homo sapiens; identical to SEQ ID NO: 111549
  Payload ID: 1844
  Gene Symbol: BFAR
  Gene Name: bifunctional apoptosis regulator
  ENST ID: ENST00000634083
  CDS Start-End: 1-309

SEQ ID NO: 111564 - DNA, 722 bp, Homo sapiens; identical to SEQ ID NO: 111551
  Payload ID: 1844
  Gene Symbol: BFAR
  Gene Name: bifunctional apoptosis regulator
  ENST ID: ENST00000634109
  CDS Start-End: 395-722

SEQ ID NO: 111565 - DNA, 2402 bp, Homo sapiens
  Payload ID: 1845
  Gene Symbol: BGN
  Gene Name: biglycan
  Uniprot ID: P21810
  ENST ID: ENST00000331595
  CDS Start-End: 187-1293
cctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgactggcatccccaaagacctccctgagaccctgaatgaactccacctagaccacaacaaaatccaggccatcgaactggaggacctgcttcgctactccaagctgtacaggctgggcctaggccacaaccagatcaggatgatcgagaacgggagcctgagcttcctgcccaccctccgggagctccacttggacaacaacaagttggccagggtgccctcagggctcccagacctcaagctcctccaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtg

SEQ ID NO: 111566 - DNA, 846 bp, Homo sapiens
  Payload ID: 1845
  Gene Symbol: BGN
  Gene Name: biglycan
  ENST ID: ENST00000431891
  CDS Start-End: 133-846
ctgcccaggagtgagtagctgctttcggtccgccggacacaccggacagatagacgtgcggacggcccaccaccccagcccgccaactagtcagcctgcgcctggcgcctcccctctccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcgagatgggcgggaacccactggagaacagtggctttgaacctggagccttcgatggcctgaagctcaactacctgcgcatctcagaggccaagctgact

SEQ ID NO: 111567 - DNA, 3377 bp, Homo sapiens
  Payload ID: 1846
  Gene Symbol: BAAT
  Gene Name: bile acid CoA:amino acid N-acyltransferase
  Uniprot ID: Q14032
  ENST ID: ENST00000259407
  CDS Start-End: 110-1366
gtcattttccctctactgctggaaaagaaggctcaagaggaagaatccaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaatta

SEQ ID NO: 111568 - DNA, 2252 bp, Homo sapiens
  Payload ID: 1846
  Gene Symbol: BAAT
  Gene Name: bile acid CoA:amino acid N-acyltransferase
  Uniprot ID: Q14032
  ENST ID: ENST00000395051
  CDS Start-End: 72-1328
ttcttttttgaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatccca

SEQ ID NO: 111569 - DNA, 2252 bp, Homo sapiens
  Payload ID: 1846
  Gene Symbol: BAAT
  Gene Name: bile acid CoA:amino acid N-acyltransferase
  Uniprot ID: Q14032
  ENST ID: ENST00000621712
  CDS Start-End: 72-1328
ttcttttttgaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataattgagacataataactaagactagaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatccca

SEQ ID NO: 111570 - DNA, 1071 bp, Homo sapiens
  Payload ID: 1847
  Gene Symbol: BLVRA
  Gene Name: biliverdin reductase A
  Uniprot ID: P53004
  ENST ID: ENST00000265523
  CDS Start-End: 77-967
ggtccgcaaagccggtggcgcccggaggctgcacggagagcggtgcccgcgtcagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaa

SEQ ID NO: 111571 - DNA, 1161 bp, Homo sapiens
  Payload ID: 1847
  Gene Symbol: BLVRA
  Gene Name: biliverdin reductase A
  Uniprot ID: P53004
  ENST ID: ENST00000402924
  CDS Start-End: 164-1054
aaagccggtggcgcccggaggctgcacggagagcggtgcccgcgtcagagcctcgccctgtcaccaggctggagtacagtggcgcgatctcggctcactgcaacttccacctgctgggttcaagcaattcttctgacctcagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacagctggcccgttggaagaagagcggtttggcttccctgcattcagcggcatctctcgcctgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaagaa

SEQ ID NO: 111572 - DNA, 443 bp, Homo sapiens
  Payload ID: 1847
  Gene Symbol: BLVRA
  Gene Name: biliverdin reductase A
  ENST ID: ENST00000424330
  CDS Start-End: 137-443
ttgtgcctgtgtacgcagttcctgtagcactcggctgggcagaaatcatctttcagcactaagggaacatagttatgatctggaccttctgggagtggtcagtgcccaagaacagtgaccgaaggaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgt

SEQ ID NO: 111573 - DNA, 873 bp, Homo sapiens
  Payload ID: 1848
  Gene Symbol: BLVRB
  Gene Name: biliverdin reductase B
  Uniprot ID: P30043
  ENST ID: ENST00000263368
  CDS Start-End: 153-773
gagccgcgggcggagagtctgaggcgtggcccttcgagccagctccgccccgttgttcctggcttgagtagggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagagaaa

SEQ ID NO: 111574 - DNA, 1392 bp, Homo sapiens
  Payload ID: 1848
  Gene Symbol: BLVRB
  Gene Name: biliverdin reductase B
  ENST ID: ENST00000597870
  CDS Start-End: 48-512
cgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcgggtgggtggtgggatcatggaggtggggctgaactggggggtactggggaggcagcccaggggcctctgaaaggtgacgctgaagccattccatgttactgtgcatttactgaacaccagctgtgtgcctgaaccttactgggtgatgctggggacacagtggtgacctgtacagccctgggccctgctcacacaaggctcacagagagaggtggtaaacagatccatgatcaaactgacatccagatcatcggagctgggatcgggaggcaggcagaggggatagggccacaatgggagaaactacaggactatgggagcccagaggaggcgtccgacttaggctgagagaggtcagggtaggcctcccagaggaagtgatagagctgtggatagacactaggtctctgccctcacagagctcccgattatggggacacagacattaagcaaatagttgccctgtataatcatttatttatttatttatttatttatagttattttgaggtttgtttgagatagagtcttgctctgatgcccaggctggagtgcagtggcgtgatcttggctccctgcaacctccgcctcccggaggtggttctcctgcctcaagtgattctcctgcctctgcctcccaggtagctgggactacagctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgt

SEQ ID NO: 111575 - DNA, 649 bp, Homo sapiens
  Payload ID: 1848
  Gene Symbol: BLVRB
  Gene Name: biliverdin reductase B
  ENST ID: ENST00000595483
  CDS Start-End: 58-549
agtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctgggcaggacgctgtcatcgtgctgctgggcacccgcaatgacctcagtcccacgacagtgatgtccgagggcgcccggaacattgtggcagccatgaaggctcatggtgtggacaaggtcgtggcctgcacctcgggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctgggacatgaggagcaaaggaagggggcaataaatgttgagccaagagcttcaaattactctagagaaa

SEQ ID NO: 111576 - DNA, 654 bp, Homo sapiens
  Payload ID: 1849
  Gene Symbol: BSPH1
  Gene Name: binder of sperm protein homolog 1
  Uniprot ID: Q075Z2
  ENST ID: ENST00000344839
  CDS Start-End: 90-488
aagcctccctgggcctctccaggggattcttgagccctggctgacaaagaccaggaagatctgagataccgggaagcctgtgactgcccatgggctccctgatgcttctcttcgtggaaacgacgcgaaattcctcagcttgcatcttccctgttattttaaatgaattatcatcaactgtggaaactataactcattttccagaagttacagatggggagtgtgtctttccattccactataaaaatggaacatattatgactgcatcaagtccaaggcaagacacaagtggtgctcgttaaacaagacctacgaaggatactggaagttttgcagtgcagaagattttgcaaactgtgtatttcccttctggtacagacgcttgatctactgggagtgtactgatgatggggaagcatttgggaaaaaatggtgttcactgaccaagaattttaacaaggaccgaatttggaaatactgtgaatgatggtttgcttgcatctgctggctatcagatacagacaaaacatgatcgatgcatccagcagtaataatcttcttcctgaaagccatggattcttcagcaggtcagaatggtctgatatacagtaacccccaattttcttaataaaataaaactctttttctccagc

SEQ ID NO: 111577 - DNA, 421 bp, Homo sapiens
  Payload ID: 1850
  Gene Symbol: BLOC1S1
  Gene Name: biogenesis of lysosomal organelles complex-1, subunit 1
  ENST ID: ENST00000553100
  CDS Start-End: 1-136
cagcttccggagccggagggggcccggcgtacccagcccccagcccgacgtgaccatgctgtcccgcctcctaaaagaacaccaggccaagcagaatgaacgcaaggagctgcaggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggc

SEQ ID NO: 111578 - DNA, 571 bp, Homo sapiens
  Payload ID: 1850
  Gene Symbol: BLOC1S1
  Gene Name: biogenesis of lysosomal organelles complex-1, subunit 1
  Uniprot ID: P78537
  ENST ID: ENST00000548925
  CDS Start-End: 16-477
cagcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 111579 - DNA, 531 bp, Homo sapiens
  Payload ID: 1850
  Gene Symbol: BLOC1S1
  Gene Name: biogenesis of lysosomal organelles complex-1, subunit 1
  ENST ID: ENST00000551926
  CDS Start-End: 295-489
cgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatag

SEQ ID NO: 111580 - DNA, 837 bp, Homo sapiens
  Payload ID: 1850
  Gene Symbol: BLOC1S1
  Gene Name: biogenesis of lysosomal organelles complex-1, subunit 1
  ENST ID: ENST00000547076
  CDS Start-End: 516-743
gacgccagctagcgggcaacgggcatgggggagagggaatttcagagaggctttttttgaaactcctttcccttgccaactggctccggtcccttgggcaatactccggtcccctcggcaacgcccccaatccccgacctgccgcaccttagccccgcccctgccccggagcgccctgcctattggccctgggagcctctcgtcctggcggcgggaaggagcgactctggagggaggagggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgaaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 111581 - DNA, 525 bp, Homo sapiens
  Payload ID: 1850
  Gene Symbol: BLOC1S1
  Gene Name: biogenesis of lysosomal organelles complex-1, subunit 1
  ENST ID: ENST00000548556
  CDS Start-End: 204-431
ggtgtggggaaccccccagagatgggcttcttggaggcctgaaaccaccggaacggaggtggggcacttgtttcctgagtccgggctggaaatctcggagttaccgattctgcggccgagtagtggagaaagagtgcctgggagtcaggagtcctgggcgctgccgctgacttcctggcgtccctgatgtggcccaggcctacatgaaccagagaaagctggaccatgaggtgaagaccctacaggtccaggctgcccaatttgccaagcagacaggccagtggatcggaatggtggagaacttcaaccaggcactcaaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtt

SEQ ID NO: 111582 - DNA, 1229 bp, Homo sapiens
  Payload ID: 1850
  Gene Symbol: BLOC1S1
  Gene Name: biogenesis of lysosomal organelles complex-1, subunit 1
  ENST ID: ENST00000549147
  CDS Start-End: 15-443
agcggtcacgtgacatggccccggggagccgaggtgagcgttccagcttccggagccggagggggcccggcgtacccagcccccagcccgacgtgaccatgctgtcccgcctcctaaaagaacaccaggccaagcagaatgaacgcaaggagctgcaggaaaagaggaggcgagaggctatcactgcagcgacctgcctgacagaagctttggtggatcacctcaatgtgggtgtggcccaggcctacatgaaccagagaaagctggaccatgaggtgaagaccctacaggtccaggctgcccaatttgccaagcagacaggccagtggatcggaatggtggagaacttcaaccaggcactcaaggtgggccatactccctacctcaccaccccaatcctgggcccccattggctgcctccagtcaggttacctcaggtttaggttaaggaggaagtagggtggtcccagaaaccccatctatagccccagtgtcagaaaaggtagagaaagaaagaaaagcagttggtgggtccaagtaaagccttttccaggagatgaataaaacgtattccccagactggaagccatactctacccattctgattcctgggctcccacctcctctcccccttcccaggaaattggggatgtggagaactgggctcggagcatcgagctggacatgcgcaccattgccactgcactggaatatgtctacaaagggcagctgcagtctgccccttcctagcccctgttccctcccccaaccctatccctcctacctcacccgcagggggaaggagggaggctgacaagccttgaataaaacacaagcctccgtttctctgtggtgtgtttcagagagctactagctccagtgtcgggggtgggagtggaaggttcaaaggtggtttccctgagggacaggtaccttttggggagagggtggaactagcttcctcttactatcccaactctcttctcctccatggcccttgtgcaggtgtctgttaggcaagcagagggtgggagttcccatccctcctgagagaaggtcctagtagccctgccccaagcttcctaattcaggacttgtttcctacagaagagaaacaaggcaaggtacaggcctggtccccagctctggctttctgcctctccacgtgctcatggcctctcccaggctaactctaagcagtgtcatgagtctgagccaggtgggagat

SEQ ID NO: 111583 - DNA, 1249 bp, Homo sapiens
  Payload ID: 1851
  Gene Symbol: BLOC1S2
  Gene Name: biogenesis of lysosomal organelles complex-1, subunit 2
  Uniprot ID: Q6QNY1
  ENST ID: ENST00000370372
  CDS Start-End: 54-482
acacccagtgcgcatgcgcagcaccccggcccggaaacagcgcggggtccgctatggcggcggcagccgagggcgtactggcgacccggagtgatgagcccgcccgagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttc

SEQ ID NO: 111584 - DNA, 2024 bp, Homo sapiens
  Payload ID: 1851
  Gene Symbol: BLOC1S2
  Gene Name: biogenesis of lysosomal organelles complex-1, subunit 2
  Uniprot ID: Q6QNY1
  ENST ID: ENST00000441611
  CDS Start-End: 219-518
agtgaaggacttgaaattatggcagatggagaatggagccgacttgatggaatgaaggcaagtggagggatgtcggaacaggctgctttggctggattagcaccgggtgtaggcgggacacttagtcattctcccttggcccagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttctt

SEQ ID NO: 111585 - DNA, 360 bp, Homo sapiens
  Payload ID: 1851
  Gene Symbol: BLOC1S2
  Gene Name: biogenesis of lysosomal organelles complex-1, subunit 2
  ENST ID: ENST00000579542
  CDS Start-End: 1-354
tgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactgggtaaccgtttttacttctgttttgatgtaataaagactgcttcttgccagcatattcttagtaaacataatagttaacattta

SEQ ID NO: 111586 - DNA, 2634 bp, Homo sapiens
  Payload ID: 1851
  Gene Symbol: BLOC1S2
  Gene Name: biogenesis of lysosomal organelles complex-1, subunit 2
  Uniprot ID: Q6QNY1
  ENST ID: ENST00000614731
  CDS Start-End: 153-452
gtgtcagatgggcagggacgcagtgaaggacttgaaattatggcagatggagaatggagccgacttgatggaatgaagacgatgccgccgtggagacagctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttcttaaataaaaaacaaaagaattaaactgtaactctactatcttaacatagaatcagtcttaccccttcttccaacccttttccttttccgtgcatgtattgatctattttttttttttttttgagatgaagtcttgctctgtcgcctgggctggagtgcagtggtgcgatcttagctcactgcaacctctgtttcctgggttcaagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcacctt

SEQ ID NO: 111587 - DNA, 2470 bp, Homo sapiens
  Payload ID: 1851
  Gene Symbol: BLOC1S2
  Gene Name: biogenesis of lysosomal organelles complex-1, subunit 2
  ENST ID: ENST00000618916
  CDS Start-End: 1-288
atgagattgccaaggaagagcttagaagtagccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcctcaaaaggaaattatgctggtcatcacaggaacatctcaacgttcgagtaaactggaggactgtggctattcctgaaccttctttgagacagaatccctcagaatctcacacttataacttcctaccttttacttgaatgctttgccatattcaggacagagactctcacaaagttcagaaaacagctggacttaccagtaaaatcaaatgagaggacctattttctctggtagtggttgattactacattattttcttaagtggctggttttttagttactatgtaaatggtcgtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggcccctcttgtttattttctatgtgagtcacattgacatgcgatcagtttgggaaatgtgatgaaaacaaagactagatgggtatgtgtgtttatgtgttgggtagggaggtgacgattgccactcataaaataaaggattttataaaataccttcctactgtgtatgtaggatttggggggatcttagggacctaatcgacttctttgcacactaaaaacatcagacaatgggacatactgactgaccagtctaggttgaaagataggcagccttacccagaacacaacattagcagctgggaaggtgtctgaggtccccaattacatatcccaaagagtttcttacttctgtttctgtcatttcccctctgttccagacagtcatcatttatcctctgttcttcctggactgttgctgtggtctcttctcatcttaactgtcccttccaaccaccctccacactgctgccagagcaatcttaaaaatgtaaactggccctattactcctgcttagaaccctgtagtgacttatcatggcctctgaaaaatctagactttcattatgcatacaagtcccttgtgtttttttgtttgtttatagacagggtctctattgtcacccaggctggagtgtggtggtgtgataatagctcaccttgacctcctaggctcaactgatcttcccacctcagcctcctgaatagctgggactaccagcacgctccaccatgccttgctaattattttttatacagatggagtctcactatgttgtccaggctggtcttgaactggcctcaagtgattctcttaccacagcctgccagagtgctgagattgtaggcatgaaccaccgtgcctaacataaggcccctatttaaacatttttcttaaataaaaaacaaaagaattaaactgtaactctactatcttaacatagaatcagtcttaccccttcttccaacccttttccttttccgtgcatgtattgatctattttttttttttttttgagatgaagtcttgctctgtcgcctgggctggagtgcagtggtgcgatcttagctcactgcaacctctgtttcctgggttcaagcgattctcctgcctcagcctcccgagtagttgagatttacaggtgcccaccaccatgccaggctaatttttgtatttttagtagagacggggtttcaccatgttggccaggctggtctcgaactcctgaccccaaatgatccacccacctcggcctcccaaagtgctgggattacaggtgtgagccaccgcacccagccatgttgatctatttttaaaaagtttttatttcctgttacactgtgttcagctatcttcagccaccttaaattcccatggatgagttttcataaactttttgaaaatagatttagatttacgggaaagttgcaaagataatacagaatttaatggatgagtttttttattgatgtgtaatagatgtatgtattttcagagtacaagtgataatttaatacatgtatataatgtgtaaatattaaatcaagagttattgggatgtccttcacctt

SEQ ID NO: 111588 - DNA, 2601 bp, Homo sapiens
  Payload ID: 1852
  Gene Symbol: BLOC1S3
  Gene Name: biogenesis of lysosomal organelles complex-1, subunit 3
  Uniprot ID: Q6QNY0
  ENST ID: ENST00000433642
  CDS Start-End: 97-705
gaaatcacagcccttcagctgccacggtgagaacgcagcactcgggttaggaagcggatctcgcaagctccgagcgtcagctgccggttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgctgcctctgggacctgactctgtctcctgtgtctcttatcaccccccacccccgctcccatcttggtgtcacccatgggggctaatccggtccccttggataatgctttatattggatatagttcaacccctactgcggagaccagggccccactatccttagatctggttcctctcccgatcctgaccctgccgcctggttctgagccttcccctggggcttggctccagcctttgttacatagttgctccttaatctgtttccaccctgggggctcaccaattttttttttttttttttttttttggagacagggtgtttatctgtcacccaggctagagtgcagtggcgggattactgctcactgcaacctcgacctcctgggctcaagtgatcctcccagctcagccttcaagagtagctgggactgcagacctgcaccaccacgtccagctgcccggttaatttttttctgtcggtttgaagaggggagaaggtctcactatgttgcccaggcttgtctcaaactcccgggctcaagcaatcctcccactgtggcgtcccaaagtgctggggttacaggtgtgagccaccacacactgggctctgctctgcctttctgagtttggtttctgcttatggtggggagcttgttcccgttcttcccacaagaacccaggatgtggcacagcttccctgccgtcttccttcactcagttggctacgcctcccatcctagctccacttccagaactgccttcaccctaggctgggtccttgttttgtttttagagacagggtctcactgtgtctcccaggctggagtacagtggcgtgatctcggctcactgccacctccacctcccgagttcaagcgattctcctgcctcagcctcccgagtagctaggattacaggcatgcaccaccacgcctggctactttttatatttttagtagagatgaggtttcaccttgttggccaggctggtctcgaactcctggcctcaggtgatccacccgcctcacctcctaaaatgctgggattacaggcgtgggccactgcgcctagccagctgggtccttgttctgctgcccaagcttggccctggttccgtgtgctggttctactttttgttctcccatctgcctcctgcctcctcccctttgagcttagccccgccctctcagcctgatttctgtttcccaagtccagcagtgtcgtgggataggttttgctttcttttactgtctccatcctacttacacctccctgatcctggggtctggggactccccatggtttccttccttctgcaggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcccagtcctggtgctttcagcgccagatgacagcactttgcagataagaacgatatgatgtgtggatttcactacatttggctcctggatgctataaaaggacttggatttctgacttggctcagggactggggttagcagtctctttctgctccttttcacctgtgttttcttccgatcccagctctggtccctcagccgcattcatatttactctcctctcccagcctgatatccctgtccctcatctcaacccgaagccaagatctgagcccccaagatggagaatggggaggagctttttatggcggactgattaaaactcttaagcatttac

SEQ ID NO: 111589 - DNA, 469 bp, Homo sapiens
  Payload ID: 1852
  Gene Symbol: BLOC1S3
  Gene Name: biogenesis of lysosomal organelles complex-1, subunit 3
  ENST ID: ENST00000592910
  CDS Start-End: 1-237
gcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggcccaaaatgatggcccctcttaacccaaggcaggggatcttcctcccaactccctggaccaaggtggcatttcctgcacacccctccaggccaagatgatgctcgctctcaactctgtaggccaaggtggcgtctcctcttgactctccagacctaaagtgacacccttcaggcacttcgggcccaattcagcc

SEQ ID NO: 111590 - DNA, 732 bp, Homo sapiens
  Payload ID: 1852
  Gene Symbol: BLOC1S3
  Gene Name: biogenesis of lysosomal organelles complex-1, subunit 3
  Uniprot ID: Q6QNY0
  ENST ID: ENST00000587722
  CDS Start-End: 75-683
gacctgcgccttttacccaccgcggcgccggtctcacgtgcagtcccttcgctcttctcccctagttcggtgccatggcgtcccagggtcgtcggcggaggcccctgcggaggccggagacggtggtgccgggggaggcgaccgagacggattccgagcgctctgcgtcctcgtcggaggaggaggagctgtacctgggtccttcgggcccgacgcgcggccgccccacggggctgcgggtggctggggaagccgcggagaccgactcggagccggagccggagccggaaccgacggccgcgccgagggacctgcctccactcgtggtgcagcgggaatcggcggaggaggcctggggcacggaggaggccccggcgcccgcccccgcgcgctcgctcctgcaacttcggctggcggagagccaggcgcggctggaccacgacgtggcggccgccgtgagcggtgtctaccgccgtgcaggccgcgacgtggccgccctggctagtaggctggcggcagcccaggcggcggggctggcggcggcccacagcgtgcgcctggcgcgcggggacctttgtgcgctggccgagcgtctggacatcgtggctggctgccgcctgctgccggacatccgcggcgtgccagggaccgagcctgagaaagacccggggccgcgggcctagccatgattctacttcccaacctgactgcaatttgggggtaggccttgct

SEQ ID NO: 111591 - DNA, 1617 bp, Homo sapiens
  Payload ID: 1853
  Gene Symbol: BLOC1S4
  Gene Name: biogenesis of lysosomal organelles complex-1, subunit 4, cappuccino
  Uniprot ID: Q9NUP1
  ENST ID: ENST00000320776
  CDS Start-End: 156-809
gggaggccggaaacaaaggtggatgcgcgtgaacagacgccctcgcaggccgccggaagcaaaggcgtgagcgcgcgtgcgtgcgtgtgcgggtgcgtgagcgtgagcgcgcggaggccggaagcgagcgctgcgcagtcgggtggtcgcgggccatggagggtagcttttcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgccgggccgcgacctgccgctgcttcgccgcgccgctgcgggctacgccgcctgcctgctgcccggggccggggcgcggcccgaggtcgaggccctggacgcgagcctagaggacctgcttaccagagtggacgagttcgtgggcatgctggacatgcttcgcggcgactcgtcccacgtcgtcagcgagggcgtgccgcgcatccacgcgaaggccgccgagatgcggcgcatctacagcaggatcgaccggctggaggccttcgtgaggatggtggggggccgcgtggccaggatggaggagcaggtcaccaaggccgaggccgagctgggcaccttccccagggcgttcaagaagctcctgcacacgatgaacgtgccctcgctctttagcaagtctgctccctcgaggccacagcaagccggctacgaagcccccgtcctgtttcggaccgaagactacttcccttgttgcagtgaaaggcctcagctctgacggcctgaccactgcggcaagaggaccccagctggggtgcttacctccagtatgaagtgaattgcaaatcctgcttatggacatatatgatgttggagtgtgggattttaaagtttactttctacaaactctccgtagtatattcatgattcagtgtagaatgtatagactttatgtcttccaagtttaaaaaaagagacagggtcttggtatgttgcccagactgttcggaaactcctgggctcaagtgatccttccacctcagcctccccagtagctgggactacggggtcgccactgcacccagcctgtgtcttccagctctaatcagaaagctgcttgtcgagggcatggggaatcaaactgaatgaacttttctctgcactgtggcaaaactgttatttttatggattttactaaatggcgttaccttttcaagatttatatgtttgtataatcataagaaaattgagccattaaagccttgttattcaatcctaatagtcagttttctagaacctacttttagggtaaatggtacattatttaatattatattaaacctcctatagcgtggattgtagaccaaaggaaatggtacaatttctgagaatatatgttgattttttgtgactaattccaaagttgtatttgaaagtatgacctcacagtcttcatttgtccatagcaaacatatgtgtgtgtgtgtgtatatatatatgtgggttgccaatgtttggtttataatttaaatgttaatagaaattttgagttttattggaaatgatttccttctgaaaagagcttt

SEQ ID NO: 111592 - DNA, 2445 bp, Homo sapiens
  Payload ID: 1854
  Gene Symbol: BLOC1S5
  Gene Name: biogenesis of lysosomal organelles complex-1, subunit 5, muted
  ENST ID: ENST00000244777
  CDS Start-End: 18-362
gggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagatatgaggaactaagttgctgagagataggaggaccaacaagaacagtgcctggcacaaagcacatgctcagtaaacatttgtcaaatgaataattgagcgagcaaacatgcccaagatcattcacacaactgagtgccaaatttgactaaggctcactcttaacctgcacactacatgtctttatttggataaatgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctataatcttgcccatagtatttacctcatttttgtgtctgttttgctgtgggtaagctttataagataaataatgtctatacatgtttcgactgtttaatgagtaatcaacaaaatctgccagagagtccctctggaaccatataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggtgaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataa

SEQ ID NO: 111593 - DNA, 2684 bp, Homo sapiens
  Payload ID: 1854
  Gene Symbol: BLOC1S5
  Gene Name: biogenesis of lysosomal organelles complex-1, subunit 5, muted
  Uniprot ID: Q8TDH9
  ENST ID: ENST00000397457
  CDS Start-End: 39-602
aggcgcagcgtggccgcgggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaagaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagcgttgcatattttacagtgcagcataatgccatgggcttccgtggatgggaagacacatgttaagttttgtggccttccagcacttactattttcagctttttaaagcatgcttagaaggaaaagcttaccaaaaatatattttgacatttagtttttccaagagctataatcttgcccatagtatttacctcatttttgtgtctgttttgctgtgggtaagctttataagataaataatgtctatacatgtttcgactgtttaatgagtaatcaacaaaatctgccagagagtccctctggaaccatataaagttcctggctttgaatgaaccagaagtgtttgcccacacagcaaatggtccatgttaaatgtaaatcctttttagtgttaatgtctgttctcataagcaggtatattatgatgaaacatgtaccagttctgtcatcactgtgatctttaaaaacctgcatttaacagtctaatttgaggctgggtgcagtggctcacacctgtaatctcaacactttgggaggccgaggcaggcggatcatttgaagtcaggagttcaagcctagcctggccaacatggtgaaaccccgtctctactaaaaatacaaaaattagcccggcatgttggtgcacgcttgtaatcccagctactcaggagtctgaggcacgagaatcacctgaactcaggaggcggaggttgcggtgagctgagatggcaccactgcactccagcttgggtgacagagtgagactccatctcaacaaaaaaaaaatctaactgaagaactaagttgattttttatttgccataaaccaagcaaaagtaaatgcaataatttcgagatttatggtaaacaaatttgaggtatggataaatctttcacatattttttattgctctttagtaaagaaaggcacaagaaagaaaatatccagctctcttgtgttatctcagtgtggcgactgcagaaaattgacaatgcctgcctgtgtaaatgtatggcttactgtcaaagcttcattcttggctgcatgttgaaaatgtgattaaagttaatagaggagatgaaataagtatttgagatttttttcaataacactgaacttctgccaactttctctatccgctactgtaggcttgacaggctcatcaatcatttgctggtacctggactaaaaagcgcacttgctgacaccaaggcatgttggaattttcttaattcagtggatggaaaaagaaatacttccaaaaatatcccacacatgaaaagggaggggagccttaaatgaaaattccctttgtaccgtagacactttttggaatgcgattaattgccaacacatcattgaacgaatgctgtaaccaagaaattaagattgtgtgtgtgaagggaatatattcttaactgtggctacccaacttgtatagcaaagatttctgatagtttgtgttcatctcatgtgaataataaatactttacccta

SEQ ID NO: 111594 - DNA, 273 bp, Homo sapiens
  Payload ID: 1854
  Gene Symbol: BLOC1S5
  Gene Name: biogenesis of lysosomal organelles complex-1, subunit 5, muted
  ENST ID: ENST00000543936
  CDS Start-End: 1-273
atgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaatgcaagcagctaatgactcagtctgtagactccaacagagggaacaggaacgaaaaaagattcatagtgaccacttag

SEQ ID NO: 111595 - DNA, 1273 bp, Homo sapiens
  Payload ID: 1854
  Gene Symbol: BLOC1S5
  Gene Name: biogenesis of lysosomal organelles complex-1, subunit 5, muted
  ENST ID: ENST00000627748
  CDS Start-End: 21-227
ggtgggcggaactggtcgggatgagtggcggagggacagagacccctgtgggttgtgaggccgccccgggcggtggcagcaagaagagggactccctggggactgcgggctcagcgcacctcattatcaaggatcttggagaaattcattcaaggcttttggatcacagaccagttattcaaggtgaaactcgttattttgtaaaagaatttgaaaatgaagactaaaccatagttaaaggcagacagtgtaatatccagtggctgtgtgttctgacggtgaagatgtagtgtaactatcagaaaatagaaggagatggaaaaacgtggtcttcgagaaatgcgagttcttgaaaatttgaagaacatgatccatgaaacaaatgaacatactcttcccaaatgtagagacacaatgcgggacagcctcagccaggttctccagagattgcaagcagctaatgactcagtctgtagactccaacagagggaacaggaacgaaaaaagattcatagtgaccacttagtagctagtgagaaacagcatatgctccagtgggacaacttcatgaaggagcaacccaacaaaagggctgaagtggatgaagagcacagaaaagccatggaaaggcttaaagaacaatatgctgagatggagaaggacctagcgaaattttcaaccttttaagaacttgaaccacaacaatcacaaactaatgagaagatgttcacctctctcctgaaaactattcccaccagaccgtttagcctctgcttcaagcttagcaatatattcagtggcactcttatatcagaagaaagaagtttctactggcattctgattggatatttaaagaagggtgccacatttttccagctttaagtgcctatatatgattatttgaatgaagaggagtaggaaggaaaatggaatcaatatactctttgttagtcagaattgatcatcttttccattgattagctcagagaactgtaggtatagacttcttagaaagataatttcattcatttctatacagggttaacaatagtttattattgtggcttaatgggaaggtatagaagctacctgtcatagcctccttggctgttggaaggatgtataaagtgttactgcatgagtaatgtagacaaaaaaaaaagccagctgtccttggagcagagatcacatttcagagaggtgagagtgaacacattgtctctgctgtggcaaagatggccacgctggtgtttgagctgcctcttgggaagc
